United States Patent 7,745,391 (HUMAN THROMBOSPONDIN POLYPEPTIDE) - sequence listing, part 124

SEQ ID NO: 350479 - DNA, 1908 bp, Homo sapiens
ctgatgaatacaccagcgactaaacaataacttgtgaagcagatgctattagttaagttatagttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350480 - DNA, 612 bp, Homo sapiens
ttttttttttttaaaaaagggaaaaaaaagagggggggttttttcctttttgggggggaaaaagggccttctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350481 - DNA, 964 bp, Homo sapiens
cctgtgtgaaatccggatccgctatcgaggtcgtttgtatcgataagcttgatcttggagggatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttcgttcacagatgcagcttgtggtc

SEQ ID NO: 350482 - DNA, 1139 bp, Homo sapiens
gattgaactatagaatgttcttacgaaaacttaagtttcaactggcagtgtatgacttctgtagccaaactagtgaggtaatttgtggagatgcccatttcatgggaccacacttgagcttcttggagtttctgctctggatcaaaattctgctgcttgtataacatgttctgaggcaaaggcttgcttctggtttgggatccttttgacacccacaacaggtttatctcccttcacaccagcatctcacttgcttctttttctctgcactttgagttgccaaatcctgttggattgcttttttgatctcaatcccctaacaccttttcttccagaaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttcgttcacagatgcagcttgtggtc

SEQ ID NO: 350483 - DNA, 866 bp, Homo sapiens
agagagtagctcccccttactttcctcccttaaaaactcagagccacctttctgcacagcttcaagtcataggcaggcttctttgtttgtcttgttttgttatttgaaactggcttatttttcaaattaccatgctggtagtgcaaaagtctcatgatttttccaagaatcaatcaagtgcatattatagagccagattatatgccatcttcctccaagctcttgcaaatttaaattgtatagttgaaaataccccccaaaatggtcagtttagggttttgcctttctctgcccctgtcccaccaccatcaccaccacataccaccctgtagctccaaatcctggtttgagtcacatgagaatatagaagagagagagagatacaaagatgaagtagagttaagagggtggtgagacttggagctgggcattggctctgaaaccaaataaattcaatgtcacatttggtgcctgtggagaaccagagatgactttttttgcttaaggtagagagcaagatggaattattatcagttaactaactggctcttattgataatcttgcctttgaaatttattgatgtttgtcttgtgacctcatgacccagattgggaaagagtttaatgatgttgctgctgttaatactaaatctcatgggagccttctggtttagagcttagtggaaaactcccaacactgtccagaaaaaaaacactattgaagcccctgtgtatatttgctttggttctcttaaaaggtgtcttgggtcttccataacttatgaccttgaagttgccaaggaataataactgttaggaaagaaaagttgataaccaagggcttgttttcttctctcccattatat

SEQ ID NO: 350484 - DNA, 2114 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350485 - DNA, 2114 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgccctttctggtgtgccaccagaaagggcattgcacggtggctccacggttgaggctaggttaccccgccagtccccatccagaaaagcacagggcgagctctgacgggctcagtgcg

SEQ ID NO: 350486 - DNA, 1628 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatca

SEQ ID NO: 350487 - DNA, 2053 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaatgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350488 - DNA, 1491 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgaaaaaaaaaaaaaaaaaaaaaaaaaaaacaaaacaaacccgggcacaatataggcggaggggcagaaaaaagcgcaacaaaagggacaagagggacaaagaggggacaccaggaacccagatttaattggtaacacgaggggaaacacctgggggatccccaaataggggcaaacgaaaaaaaacgaaaaccccaggaacacacggaataaaacaagccaaa

SEQ ID NO: 350489 - DNA, 1989 bp, Homo sapiens
agccggtcagacaagcactggacgtggcggccattttgttttggacaccgagcaggagctggcggccgctgcagacgaaaggcaggaaagggcaggccgggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350490 - DNA, 1729 bp, Homo sapiens
agggtaaaacaacgccaagcgaatccgcaatgatgattttagttttttctgcagtgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350491 - DNA, 1878 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350492 - DNA, 1913 bp, Homo sapiens
gattgaactatagaatgttcttacgaaaacttaagtttcaactggcagtgtatgacttctgtagccaaactagtgaggtaatttgtggagatgcccatttcatgggaccacacttgagcttcttggagtttctgctctggatcaaaattctgctgcttgtataacatgttctgaggcaaaggcttgcttctggtttgggatccttttgacacccacaacaggtttatctcccttcacaccagcatctcacttgcttctttttctctgcactttgagttgccaaatcctgttggattgcttttttgatctcaatcccctaacaccttttcttccagaaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350493 - DNA, 2741 bp, Homo sapiens
ggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccacctgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350494 - DNA, 1406 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350495 - DNA, 1004 bp, Homo sapiens
  misc_feature (1001)..(1001): n is a, c, g, or t
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaacatgtttatggtcttttggcctattnctc

SEQ ID NO: 350496 - DNA, 1303 bp, Homo sapiens
caggcatggaattagggatttttaagaaatgtaaggaaaggagatttgactttcttgtgtttatttacatcttaaggtaaaaagtggaccgtctggaaatagattctcagaggaaaaatggagcacacgggcctttttgagaaatcaatcttgttcttaagtcacaagaactcaagtgaacttgtaatttaagttttgcccagagtgtgatgaacttcctatggtgtttgagtaagcctttgaagacagtggtatgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350497 - DNA, 845 bp, Homo sapiens
ttgaataaagagtagcttaatctgttcacagtatgcagcttgccccagccaacctaaaaactaactgaattaccttcatttaaccctcaccgccttcctttggttagaatctactttgtgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350498 - DNA, 707 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtgagagaatgggtcttaatgctccagaagcagctggtgatctctgtgagggagtccactgaggctgtcaggacgtgatggatgattgcaaagtggctcagggcaaaaagctgagtctctgatcagggtccttgtggcctgctgcttatcacacaagtccggtccttctc

SEQ ID NO: 350499 - DNA, 1659 bp, Homo sapiens
ggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccacctgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtgagagaatgggtcttaatgctccagaagcagctggtgatctctgtgagggagtccactgaggctgtcaggacgtgatggatgattgcaaagtggctcagggcaaaaagctgagtctctgatcagggtccttgtggcctgctgcttatcacacaagtccggtccttctc

SEQ ID NO: 350500 - DNA, 459 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcggtgaggcagccaacagcaacttcaactccttcctaagaaaacattacttaacttggccctggggtccaatgcacaa

SEQ ID NO: 350501 - DNA, 392 bp, Homo sapiens
ctaactgaattaccttcatttaaccctcaccgccttcctttggttagaatctactttgtgtctcttggatttacctgcatatacattgtatgcctcctctctaaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggttagtcagctaccaacttcagagagtagctcccccttactttcctcccttaaaaactcagagccacctttctgcacagcttcaagtcataggcaggcttctttgtttgtcttgttttgttatttgaaactggcttatttttcaaatta

SEQ ID NO: 350502 - DNA, 434 bp, Homo sapiens
ggtcgactactactactaattcgcggccgcgtcgacccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgaaaaaaaaagtcgacgcggccgcgaatttag

SEQ ID NO: 350503 - DNA, 1300 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgaaaaaaaaagtcgacgcggccgcgaatttag

SEQ ID NO: 350504 - DNA, 3066 bp, Homo sapiens
ggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccacctgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350505 - DNA, 2275 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtgagagaatgggtcttaatgctccagaagcagctggtgatctctgtgagggagtccactgaggctgtcaggacgtgatggatgattgcaaagtggctcagggcaaaaagctgaaacttctctggaagaaagagaagttcagagaattccaattttggcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350506 - DNA, 3227 bp, Homo sapiens
ggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccacctgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtgagagaatgggtcttaatgctccagaagcagctggtgatctctgtgagggagtccactgaggctgtcaggacgtgatggatgattgcaaagtggctcagggcaaaaagctgaaacttctctggaagaaagagaagttcagagaattccaattttggcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350507 - DNA, 1323 bp, Homo sapiens
  misc_feature (881)..(881): n is a, c, g, or t
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagagcggcgtatgataggtcggngaagacgtaactttatataccttaacctaatcttaaactattaacaatacccttactctcctatattaaccaaacatcatctaacaaccacatatatacatatatatctctcaaaccaataattaaattctacccattcgccctatatatactcgtattaatcaacacatctataaataaccttaacattacacattataataaatttcaattattctttatttacctttaacaataatcttttacttactttccaccatctttttcattatatattccttgtacttttaatccttctttatttaaacccttttttccttttatctactcgtaatttcacatttgttaatctgttcttttatttctttcttctccctgtcctttgtcttttgcatgtcattactttttccctttgtcttatcttttttctctttcttgttct

SEQ ID NO: 350508 - DNA, 1524 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaacgtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350509 - DNA, 1340 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttcgttcacagatgcagcttgtggtc

SEQ ID NO: 350510 - DNA, 1393 bp, Homo sapiens
  misc_feature (824)..(824): n is a, c, g, or t
  misc_feature (1234)..(1234): n is a, c, g, or t
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtggtgttcgaggtcgtggaggtcctgggagagggggcctagggcgtggagctatgggtcgtggcggaatcggtggtagagcggcgtatgataggtcggngaagagggggcttcgtggcccgctgtcctcgtctgtcgctggtggtgccttgcccttgctgccccggtctcgctcctggtcctccttgcccttccgctggctctctctctgtccgccgcgcttggtcgcttcgcctgctgcgcggtctccccctcgcctcgccccgtctccggcccctcgccctcgccccgcccttctctctcgtccccttctccccgcctggctctcgccccgtcccttgccgcccccgtcgccgcccccctccccccgttcgtcgccctttctccgctccctgttcccggctctccgctgccgtgccccctctgggcccttccccggtctttgctcgcttgctcacgccttctctccttctctggccccccgtcgctcttttgtccgtggcttgcccncttctcctcgcggccgccccccgctcgcgcttcttgcctgctcttcgttccgggtgcctcgccttgcgctctgcttggccgcctccctctgcccgttccttctcgcttcgccgtctcttccacgccctcgagctcctcctctgcctctccctccgcccg

SEQ ID NO: 350511 - DNA, 1391 bp, Homo sapiens
agccggtcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtggtgttcgaggtcgtggaggtcctgggagagggggcctagggcgtggagctatgggtcgtggcggaatcggtggtagagcggcgtatgatacgtcgttcaagatgccctttgccaccccgctcctctcgcacggtcgtctctctatccccccccggcccccttctctgtgtccccctcgctcggccccccctcgccctcttctcgttcgctcctctgtgcgttctcccgctcgttctctctctttgcgccctctctctcccccctctccgccttccctggctctccttctgcgcctcctctctctccaccctcgttcttctccgccccttctgggtattctctccgctgcggcgtcgctccccctgcgcccccctcacctcttccgcccgtcggctttcctctgtcttcctctgcattccctctcgcccctgacttctactcccgcatctgcgcgctctacctcctctcctctggccctctctgctctctctccccctgctctcgctccctctcctccgcctcttccgccgcgctttggtcgtcttctgtctgcttcttctactcgcgtcgctcgtcggcgctctcctctgcctcctcttccccccctacgtcccggtgtgctcgtagctccccctcgctccgtcccgtcggccgcctcgcgcct

SEQ ID NO: 350512 - DNA, 1924 bp, Homo sapiens
tgttaactgaattcacactgcttctcagataaccacaattgtcagttgtcataaggtaactagaattaaaggtagaaatagctaggacaactcaaaatattttttcaaatctcccctacattgttcctgtgtcagaaaaactcagtctcctgacacatgaggtcagctagctcattagacttgataagtttaaggacaggtgagatgactttccagaagggtctccaataaacttaatttgaaaactgtcttgtcttcacacccctgatgctctgtgctcttgttaccacctccctatcttaccaaatggggttatctgtcatgtattttaattatgaacttagtgaatctcaaatgttaggtaattttatcttaggattgattaaggttttttaaaattatagttgccagttaattattttcctttattgatagaataaaatttgttaaaatagcatttagagatgatcatgtgatagaggattcattatgtgtgctttccatgtgttgctttctacccattgtgtttcctttttttccagatttctcctctttgccctgcccttcagcttttctcagctaggccccactgctctaaggggcatttactacagcacctattaaacttacttgtaactgtctctttttttttttttttcccctttgggccaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaattgttcgcttaaatccaaaaaaaaaa

SEQ ID NO: 350513 - DNA, 3328 bp, Homo sapiens
ggactgggtcattgatttaatatgggggttgaaagtaaagtgaaatatgatgggtgctcaggattctgatttgggtgggtgactacctttcactgaggtaagttatataggaaatggtttctggaaaacgttagtaaggtcagtttttaaacactgaatccaaggttgtcttctggaatatccaaattggttatgaccagaatgtgattcattatactaagctaaaggaatagattaaagaattagcaacagtggccgggtgcagtggctcatgcctgtaaccccagcactttgggggaggcccaggtgggtggatcatttgaggtcaggagtttgagaccagcctggccaacatggtgaaacctaaaaatacaaaaattagccaggtgtggtggcaggtgcttgtaatcccagctgcttgggaggctgaagcaggagaattgcttgaacccggaggcaggggttgcagtgagccaagatcacaccattgcactccagcctgggtggcagagtgagactctgtctcaaaaattaaaaagcaacagtgtatatgcaatagttgcaagatgtaagatcacccaaagagtatgcagagggaaatgagggacagaacccagaaatattaatacccagggagtgaacaggaggaggaccccaagaagttactgagtcagatttttcccactcatccaggtgaaagtttaggtcaataatgtgaaataccagagggattaaatgtctacagaaataaaaccatgtctcacattaagacaaacaagtaggttggagggatattttgaaaggcaaggtgatattaaactttattctgaaagtagtttgttagagaaagaggcatgataagagttgcagttaactgattggaaactatgcagcagatgaaactggaataaaggaaactcatcaggaaatgattatagtaataagggccagaaataagggcttgcttgcctgaactaaaaacaaagaggatacaaaggttctagaaatatttcaaaggaattagctttaattcagcaatactcattgagaatcacctatgcacctggctctgaagatgaagtgctgagtaaacttagacatggaccctgctatcatggagatggcagattattggtcagaatgctcttacctgtcattgtagcaattttgttagatccttaatacctctgaattgctaataaacttgttttggctgaaaaaatagtcctgtgaattttaccatgcagttaaataagaaactaaaagcaaacctaaataccaccaaaaaggttagtagtctgttatatgcattagccttaatctaaggaaatattttattataggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtatgtagcacacttgcttgatatattacccaattactttccccctcacttttctaatatttgggtttcattttgctttaggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataatgttgtctgaatttaccacctttgtcagaagtcaactcaaagcttccaatgtagtcagtctataattccttaatcaaagtcagcaatttatggacagcttcagcatctacagttgacctttcactagccaggcaaacttcccttaaaatt

SEQ ID NO: 350514 - DNA, 703 bp, Homo sapiens
gcaaccaatccccctcagatacaaagggaggactgtaactttagtcttagaaaagggctgttaccttagaactttgtcatgtgtaaaatacagtataaattgttttaaatgatgtatgaggtctcatgctttaaaagatcattagaaaagaattatttcatttctaagcaagcaattaaaaaaataatgtcttccatttgtttacaggataaatgtgcatcctcactaggaaaaaaaagtttgtgtgaaaagctggatccaaccattatcagttttgaaataaattcctttctgaaataaaatattagaaacataagcatttaaacaaaaaattttgtttttcaacatcattttatcctttatataccattacacttacagaatctgacacataatttctctgctgttaagaaatagcagtatgggccgggtgcggtggctcaggtctgtaatcccagcactttgggaggccaaggcaggtggatcacgaggtcaggagttcaagaccagcctggccaagatggtgaaaccccgtctctaccaaaaatacaaaaattagccaagtgcagtggcagaggcctataatcccagctacttgggagcctgaagcaggagaatcacttgaacccgggcagcagaggttgcagtgagccaagaaaacgccactgcattccagcctggacgacagactccgtctcacaaa

SEQ ID NO: 350515 - DNA, 4027 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcata

SEQ ID NO: 350516 - DNA, 4442 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataatgttgtctgaatttaccacctttgtcagaagtcaactcaaagcttccaatgtagtcagtctataattccttaatcaaagtcagcaatttatggacagcttcagcatctacagttgacctttcactagccaggcaaacttcccgaaataatcgtagtgactgattcatcttctcaaattctcttgcttttctatgtcccttttgaataacttcctctgggagattagcaagccttgctgcattaaagccatagcttttaggacaagctcccttaatgaatttatagaggaacgtaatagtctcctggctggggtcttcacattcattttctaccatgcatgccatatgtcctaggcgcacagcaacattttgagaataatcttctactaatgaatggtagtgagttgaaaataat

SEQ ID NO: 350517 - DNA, 3994 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatgg

SEQ ID NO: 350518 - DNA, 1571 bp, Homo sapiens
ccgcaattcgtggtggtggtatagaatggggtctcctcctccggcggggtcgaagaaggtggtgttgagtttgcggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcata

SEQ ID NO: 350519 - DNA, 3451 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggataaatgtgcatcctcactaggaaaaaaaagtttgtgtgaaaagctggatccaaccattatcagttttgaaataaattcctttctgaaataaaatattagaaacataagcatttaaacaaaaaattttgtttttcaacatcattttatcctttatataccattacacttacagaatctgacacataatttctctgctgttaagaaatagcagtatgggccgggtgcggtggctcaggtctgtaatcccagcactttgggaggccaaggcaggtggatcacgaggtcaggagttcaagaccagcctggccaagatggtgaaaccccgtctctaccaaaaatacaaaaattagccaagtgcagtggcagaggcctataatcccagctacttgggagcctgaagcaggagaatcacttgaacccgggcagcagaggttgcagtgagccaagaaaacgccactgcattccagcctggacgacagactccgtctcacaaa

SEQ ID NO: 350520 - DNA, 3250 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggataaatgtgcatcctcactaggaaaaaaaagtttgtgtgaaaagctggatccaaccattatcagttttgaaataaattcctttctgaaataaaatattagaaacataagcatttaaacaaaaaattttgtttttcaacatcattttatcctttatataccattacacttacagaatctgacacataatttctctgctgttaagaaatagcagtatgggccgggtgcggtggctcaggtctgtaatcccagcactttgggaggccaaggcaggtggatcacgaggtcaggagttcaagaccagcctggccaagatggtgaaaccccgtctctaccaaaaatacaaaaattagccaagtgcagtggcagaggcctataatcccagctacttgggagcctgaagcaggagaatcacttgaacccgggcagcagaggttgcagtgagccaagaaaacgccactgcattccagcctggacgacagactccgtctcacaaa

SEQ ID NO: 350521 - DNA, 873 bp, Homo sapiens
aacctgggagttcgaggctgcagtgagctgtgatggtgccactgcacttcagccttggcaacaacaacaaaaaaagggccagcatgtcatccctaaagagcagttttcaacagtgctagaggtcatgaactatatttgctttcttacctcatttgcatttctgcaaatgagtctaatttaaggataaacctgtaacattttcatcttttcattgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcata

SEQ ID NO: 350522 - DNA, 752 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggctaggcgaagtggctcacgcctataatcccagcactttgggaggctgaagtgggcagattacttgagcccaggagtttgagaccagcctgggcaacatactgggacctcatttctac

SEQ ID NO: 350523 - DNA, 912 bp, Homo sapiens
cctcggatgcgcgtgggcgctgtataaatttatcagaaatcttcgcagatatttctcatctttgttgatacaatccccctcctgtttgtgaaatagtaagtcccacccgtttaattgagtgccctcttcccgttgaaactttcgcactctctttgagaattgtcttttcacgacaaacgcttgctcggttttgtagcccccgcggggcggtcttttcttgtattgtggtgaagagaataatcccacagttctccctaatattttcacttgtgcccccggaagtttctcctcttcagggaatcacctccttatggagccccacttgtttcacacatctataccctatacattgggccccccccgtcggcgccacaacacaaagtggttctatagaagaaggtctttttcaataggggcccaagagcggcccacaaattttttttttttttttttttttttttttttcatttttaaaaaataaagtttattagatcataatgttgtctgaatttaccacctttgtcagaagtcaactcaaagcttccaatgtagtcagtctataattccttaatcaaagtcagcaatttatggacagcttcagcatctacagttgacctttcactagccaggcaaacttcccgaaataatcgtagtgactgattcatcttctcaaattctcttgcttttctatgtcccttttgaataacttcctctgggagattagcaagccttgctgcattaaagccatagcttttaggacaagctcccttaatgaatttatagaggaacgtaatagtctcctggctggggtcttcacattcattttctaccatgcatgccatatgtcctaggcgcacagcaacattttgagaataatcttctactaatgaatggtagtgagttgaaaataat

SEQ ID NO: 350524 - DNA, 285 bp, Homo sapiens
gccgaaaagaacagcgtgtcccacaaagaacagtatggaggtaactttaactgtagttgcttttctttttgtaatgaaagaattttcaagaaacaaaaaagggaatgtcatccttttttagaagtaatgattatggatgataagaatatttgctttactagtttctgttttgtttttgaagggcgcctcaacttcaactacagaaaactttggtcatcgtgcaaaacgtgcaagagtgtctggaaaatcacaagatctatcaggtatttcctgtgggaaagtaac

SEQ ID NO: 350525 - DNA, 433 bp, Homo sapiens
gaggcacaaagaggttaaattacttactcagggtcacacaggaagtggaattcctgggattcaaaatgtggcagctcggctccacaactatagcatagctatactatactgcctgcagctctctgcatctatttacacttctagttctcttaattttgtcttgtaatggtcactaaaattctagtgtaagaattttaaccactacctaatgtaaaatccttactgtattctctaggctcacaaatgttgaccttgtaacttttatttttaaataggcaatgcattagcaggaattcaaattaggacaaacagttgtccaattgttcggcataacaaaattcatgatggccagcatggtgggatttatgtggtaagttaatgtatatagttccctataaactcatgcatcaaaaccagggggataaagggtttc

SEQ ID NO: 350526 - DNA, 332 bp, Homo sapiens
ggaatgttttgcattaatgacatgtttgagaaaagtaatttaagcttttgctttttagatgtcatacttgtaacaccacagatcgaaatgccatatgtgtgaactgcattaagaagtgccatcagggacatgatgtagagtttattagacatgataggtatgtagcacacttgcttgatatattacccaattactttccccctcacttttctaatatttgggtttcattttgctttaggtttttctgtgactgtggtgctggaacactgtctaatccttgtacattagctggtgagcctacacatgatacagatacactatatgactctgct

SEQ ID NO: 350527 - DNA, 738 bp, Homo sapiens
tttgtcagaagtcaactcaaagcttccaatgtagtcagtctataattccttaatcaaagtcagcaatttatggacagcttcagcatctacagttgacctttcactagccaggcaaacttcccttaaaattaaaaaaaaaaaaaaaaaagtttttttgttttttcatagtgcatcatcccttccccttttactgtttctttgaaacttaaggtcagttagttataattccattatagttagttagttaccgaaataatcgtagtgactgattcatcttctcaaattctcttgcttttctatgtcccttttgaataacttcctctgggagattagcaagccttgctgcattaaagccatagcttttaggacaagctcccttaatgaatttatagaggaacgtaatagtctcctggctggggtcttcacattcattttctaccatgcatgccttaagaaagaaaaatattagcgatacatgtgctagcaagagaagtgccctctcaaaaaaccgaatttgtggaaaaaaacaatttgcacataccatatgtcctaggcgcacagcaacattttgagaataatcttctactaatgaatggtagtgagttgaaaataatgtacgacattttatagtctcagcaagttctttaacaactgcatttgctattgccgtcccatcaaatgttgcagtacctcttcctgttaaagtaaaatatgcataaggaagtaactcaaaggaat

SEQ ID NO: 350528 - DNA, 3972 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgttggatatatgacaataagtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcata

SEQ ID NO: 350529 - DNA, 4178 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtctccttgaagaaaatgatattttcaggaatgctcaagcaggtgttctcatcagcactaatagtcatccaatcttaaggaaaaacagaatatttgatggatttgccgcaggtattgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggaagggatgcactgtaaaacaaaagtattcttgtaactcagttttgtgaaaggtaaaaaactactatgttttaagtacactttagaaagtctcttcaaaacaaacagtcctgtatttgaactctgttcatagtttttttttgaacagtttagacaaaactgctggaaattaaaccaatttcctgcattaagctgagacaagtatatatacagccctatacagtttcatagcttttcctcccccatttatgtgtattggtgacagtgggtataaaacagcctgaaagtgtatgcatgtaccataacatctagacttaatatattgtggagtattcaataaccattatgtagaaggtagataagaattaaaagggtttaatttcctagaaagaaaatggaaaaatggtcatttttaaaaaataaagtttattagatcataatgttgtctgaatttaccacctttgtcagaagtcaactcaaagcttccaatgtagtcagtctataattccttaatcaaagtcagcaatttatggacagcttcagcatctacagttgacctttcactagccaggcaaacttcccttaaaatt

SEQ ID NO: 350530 - DNA, 2666 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggactggaagcaaccccaaaattagacgcaacaaaatctggggaggacagaatggtggaattctagtttataattctggtctaggctgtatagaagacaatgaaatatttgacaatgcaatggctggagtctggattaagacagatagtaatcctacactaagaagaaataaaatccatgatggaagagatggtggcatctgtatatttaatgggggtcgaggtattgttgttaattttgcattagtgaaaaatccagttttccattattcttccatatctttaatgatcaatgacattgctaactaagttataaatgagtgaatctcaagtctttttccttatcaagttgaactggtttaggagattagtgcctagagttaagagacaaatgtttacaatacttttccttttgtagccactttgagtctgcagttgtcagtaagcctttttaaagatagaatttgtttacattctctggaccttttaaaattcagaatagtaatatgattataataaacttcaaagtcaagttatagaaatagatgtgagaaattgatctgtaaatatctgaaaatgtctttagtaaacgggtattgcttttgtaactgtttt

SEQ ID NO: 350531 - DNA, 2246 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaattcaaattaggacaaacagttgtccaattgttcggcataacaaaattcatgatggccagcatggtgggatttatgtgcatgaaaagggacaaggagtaatagaagagaatgaagtttatagtaacactctagctggagtctgggtgacaactggcagcactccagtactgagaagaaaccggatacacagtggcaagcaggttggtgtttatttttatgacaatggacatggagtgctagaagacaatgatatctataatcatatgtattcaggggttcagataaggtaaatgttttcatatttggctatcttttgggagggagttaggagtatgtggggtgtgtaaaagaaatttgcttattgtttaatgcccaatctttatccccctattgtatatatattcacattcttaaaataatcttgacttaaattgtcagaatgtagctttccttggtctaggtgaggacagaagccactg

SEQ ID NO: 350532 - DNA, 1571 bp, Homo sapiens
  misc_feature (1489)..(1489): n is a, c, g, or t
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcagcagcacctgctgaacagtatcttcaggagaaactgccagatgaagtggttctaaaaatcttctcttacttgctggaacaggatctttgtagagcagcttgtgtatgtaaacgcttcagtgaacttgctaatgatcccaatttgtggaaacgattatatatggaagtatttgaatatactcgccctatgatgcatcctgaacctggaaaattctaccagattaatccagaagagtatgaacatccaaatccctggaaagagagtttccagcagtcgtataaaggtgcacatgtaaagccaggatttgctgaacatttctacagtaaccctgcaagatataaaggaagagaaaatatgttgtattatgatactattgaagatgcccttggtggggtacaagaggctcattttgatggacttatctttgttcattctggaatatatactgatgaatggatatatattgaatctccaatcaccatgattggtgcagcacctgggaaagtggcagacaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgcgtagtgtcacattgatcatggcatgcgtactttgaagtgcatataccagaataggaagcagcttgagtaaagctatgtaacctacagtgttcatggaattcacatggcagactgaggaattatgtcatganaaggagaggcattcatgaggataaatctatcaacaactttcagtgattgatacctaatagtgcccccataagggattctttt

SEQ ID NO: 350533 - DNA, 585 bp, Homo sapiens
atccttaattaaattaatctccccccccccccccccccgcccggcaaatgaactccgtccgagccgccaaccggagacccaggcgagtgtcgcggccgcgcccggtgcagcaacagcagcagcagcccccgcagcagccgccgccgcagccgccccagcagcagccgccccagcagcagcctccgccgccgccgcagcagcagcagcagcagcagcctccgccgccgccaccgccgcctccgccgctgcctcaggagcggaacaacgtcggcgagcgggatgatgatgtgcctgcagatatggttgcagaagaatcaggtcctggtgcacaaaatagtccataccaacttcgtagaaaaactcttttgccgaaaagaacagcgtgtcccacaaagaacagtatggagggcgcctcaacttcaactacagaaaactttggtcatcgtgcaaaacgtgcaagagtgtctggaaaatcacaagatctatcaggtatttcctgtgggaaagtaacaaatagggtaaaataattttttttaattttgcttgataccaaaaaatgaaaattaagtgtattcgagtattacc

SEQ ID NO: 350534 - DNA, 2616 bp, Homo sapiens
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctggggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtg

SEQ ID NO: 350535 - DNA, 2902 bp, Homo sapiens
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctggggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttc

SEQ ID NO: 350536 - DNA, 2414 bp, Homo sapiens
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctggggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtg

SEQ ID NO: 350537 - DNA, 506 bp, Homo sapiens
aagaaaaaaaaggcaggtctcacaatcccttggttcaactgattgtcggctaagattttacttagtaagtaattttgtaccagtactaatacgcaatatttgacgaacatcttcccctttttttttttttttgagatagagtctcactctatcacccaggctggatgacatgctgtctcaataaataaatacattcatctgaaaatgatgaggacagacacaaacacaaagaaagccatcaagaagcagaagtcactcaagatacaggtctcgtgaaaggcatcatcgtagtagagggaaaagaagtagtctcaatccagaagcagagagaagaacgatcatgatctagaagcaggaaaagaaaaccatgggctggacatggtgcttcacacctgtaatcccagcactttgggaggccaagtcaggcagatcacctgagattcaggagtttgagaccaacctggccaacatggcaaaaccctgtctctactaaaaatgcaaaaatt

SEQ ID NO: 350538 - DNA, 811 bp, Homo sapiens
  misc_feature (648)..(648): n is a, c, g, or t
  misc_feature (704)..(704): n is a, c, g, or t
  misc_feature (721)..(721): n is a, c, g, or t
aagaaaaaaaaggcaggtctcacaatcccttggttcaactgattgtcggctaagattttacttagtaagtaattttgtaccagtactaatacgcaatatttgacgaacatcttcccctttttttttttttttgagatagagtctcactctatcacccaggctggatgacatgctgtctcaataaataaatacattcatctgaaaatgatgaggacagacacaaacacaaagaaagccatcaagaagcagaagtcactcaagatacaggtctcgtgaaaggcatcatcgtagtagagggaaaagaagtagtctcaatccagaagcagagagaagaacgatcatgatctagaagcaggaaaagaaaaccatgggctggacatggtgcttcacacctgtaatcccagcctcattgagcttttaatcaaataattttcatgctctgagttattaattaatggcactttcaagtattacttacctcaatccaaacttaatatgttaattgacaagagtattgccacatatgacatatatatatatatatataagaaagttgtccttatccagccgttaagtgttcaaaatctaataaaattttctacttggaatctcataagaaacatcaggtccatggacaacaacatcagntctctgggtcattcctttctggcactgggctaaggacatcaaacttcagatgctgnggttcatttcatcaagngctgaacagttttgaaatttctcttggcccttaaacattcacagtgtggagggtacgtcactttttggacagttaacagatgacctaagc

SEQ ID NO: 350539 - DNA, 380 bp, Homo sapiens
ctaaagggtgaatcatgtttaagaaggtcaacaggattgagcacaagaggaataagacagaaaaaccaaaaaagcttaatccatggattccacgcatcttcaaccacaaatgctttgtcaccttccttactggctgctatagttgcctctggaaattcagacaatgggaaaaaactaaagttggattttgttgctgcacttgggtacagactgataaggagctggaccacattttctcagatgcggggagcataggctgactgctgggccccatgagggctctttatggtctccaggactggggatgctagggctccatttcttccataaaagtattgcaccaatgttaaacttactgaaacatgtacttgctttcttca

SEQ ID NO: 350540 - DNA, 390 bp, Homo sapiens
actgcagaagatcttttcttttgccttttggtaactagcctaacaaattttacattttatcaaaataattcctatgctattactattaagttttggtttgcttaggaaaaaactgagattaaaatttttcaattgattattacatccataaattaaccattaatgtcaaagacacattgatgcaagaccagaatatgtgccactgtgtcagattaacaaggttttcttgaagcattaactccatagtaaaggttataaaaggcttgttgaagttatatcttacaatcaagattaaaatgttatagagtgtttatacaatattgaaaaacaaatttaactggcttcgtgctgttctttttttattttttgagacaaagtctgtcacccagg

SEQ ID NO: 350541 - DNA, 1655 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgg

SEQ ID NO: 350542 - DNA, 628 bp, Homo sapiens
cagggtctgacctaggattttgtatttcttccagatatcaacacaaaatgtcgacgtttctgagtattgttatggtttggctgccaataagagacaatgcaaacttgaatctcaactgagacctaatctaaatagtcacagttggtcaggcgccatggctcaagcctgtaatcccagcactctgggaggccgaggtgggtggatcacctgaggtcaggagcttgagaccagcctgaccaacatggcaaaaccccgtctctactaaaaaatgtaaaaattagctgggtgtggtggtgtacacctttcccagctacttgggaggcggaggcaggaaaagtgcttgaacttgggaggcggaggttgcagtgacctgagatcacgtcaatgcactccatcctgggcaacagagcaagactctttgtcaagaaaatatataaaataaatagtcgcaattctgaattattggagctgaagtctttactgttcttgaggttttcagaatggttccttggtaaatatatctcaccatacactcagaaaatatcatcctctcctgacagcctctattttaaatccatgccaatttgtaagagtgcctttctagtcaccaaaaataataaaatactac

SEQ ID NO: 350543 - DNA, 2513 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgctcggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatggtgga

SEQ ID NO: 350544 - DNA, 2395 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatgtcaggagcttgagaccagcctgaccaacatggcaaaaccccgtctctactaaaaaatgtaaaaattagctgggtgtggtggtgtacacctttcccagctacttgggaggcggaggcaggaaaagtgcttgaacttgggaggcggaggttgcagtgacctgagatcacgtcaatgcactccatcctgggcaacagagcaagactctttgtcaagaaaatatataaaataaatagtcgcaattctgaattattggagctgaagtctttactgttcttgaggttttcagaatggttccttggtaaatatatctcaccatacactcagaaaatatcatcctctcctgacagcctctattttaaatccatgccaatttgtaagagtgcctttctagtcaccaaaaataataaaatactac

SEQ ID NO: 350545 - DNA, 1513 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgg

SEQ ID NO: 350546 - DNA, 2097 bp, Homo sapiens
gtattcttcttcaatgcggtgcagctactcagtgaccagtacaagttaacctagccaagtggccaatagacatgctgcctctatgatgaatcgcaggtggccctagcacatagctccgtctatcgagcactactatggactgtgagcaaataatgccctggtgagttatcctgatgctatacgagatagctattcttctatattgagcgtgctacgttgatcttgatccgtaatctgttggacacaggaaagtacaacacgtactgtcgactcatctagaatatacagcgcacactcgcacgatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgctcggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatggtggaaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttggggctgagcaggacagtggctcatgcctgtaatcccaggctccctacttagggaggctgagcccaggagtttgagttcgtttctaaaaaaataaaaatatatacaaacgtc

SEQ ID NO: 350547 - DNA, 325 bp, Homo sapiens
atataagttttatatgcactggaaaaccaaaaaagttgtgtaacttactttattgtgatatttgctttattgcagtggtctggaacctaacctgcagtgtctctgaggtatgcctgttttcttatgtgattctgatgaagtcacaagtttgaaaaccactagactagaggagcagagaccacaggactgtgatggtgaagaccacagtttagaaggattaaaagcccagagatatatgtatctttatcatagacacatatatctgttagcagttaaaaactaccagaataagattacgttgttacaaagaaagttgaatgtgtta

SEQ ID NO: 350548 - DNA, 3086 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgctcggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatggtggaaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttggggctgagcaggacagtggctcatgcctgtaatcccaggctccctacttagggaggctgagcccaggagtttgagttcgtttctaaaaaaataaaaatatatacaaacgtc

SEQ ID NO: 350549 - DNA, 1623 bp, Homo sapiens
ttgtcggcgttcgcggttgtttggccatccagtgccttccgcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgg

SEQ ID NO: 350550 - DNA, 1444 bp, Homo sapiens
cactgggaggtaagggaagccctcctggttcccacaggctatgatgctgcatggcagagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgg

SEQ ID NO: 350551 - DNA, 414 bp, Homo sapiens
tggaatccatgtgaatattcctttcatcctcaattacaatttatagaaagctgagatctgtttattcatgtgtcaaggcgaagctcaaataccaccttttatccttccctacctctggacaacttcagtctccccttttcccatcctcctgaaagtctatcaaagtcattaccagaatcttccttaatctacagcctgtgttggtccgtgctcattgttcatttccctccatgactgaaaccacagaactcttccctttacttcagtgaggctctgaaagccttgagacagaaactccttaactttcctttggcactgcctactagttcacctgtccctccttgggttagcctccccgtggagtcacaatagaagagttctcctcttcctgagattccatttgggggaccggct

SEQ ID NO: 350552 - DNA, 730 bp, Homo sapiens
tggaatccatgtgaatattcctttcatcctcaattacaatttatagaaagctgagatctgtttattcatgtgtcaaggcgaagctcaaataccaccttttatccttccctacctctggacaacttcagtctccccttttcccatcctcctgaaagtctatcaaagtcattaccagaatcttccttaatctacagcctgtgttggtccgtgctcattgttcatttccctccatgactgaaaccacagaactcttccctttacttcagtgaggctctgaaagccttgagacagaaactccttaactttcctttggcactgcctactagttcacctgtccctccttgggttagcctccccgtggagtcacaatagaagagttctcctcttcctgaagccccctcactccaagatatcccctgcttattcttggttccttattatcagcatttaaatgctcttaaatctctttcaccttatttttttaaaaataagttttcctctttggtagtgctttttctccatttcatcattcaaacatcttcaaagcatgtttggcaaatcctgcctcctagactcttgttttctcctttctcatctgctatgattttaatgtgtcttccaaaagttcatgcacaggaaacctaatccacaatgcaatgcaacagtgttgagatgtggggcctaattagaggtgcttaggttatgagggcaaaaccctcataaactaatt

SEQ ID NO: 350553 - DNA, 424 bp, Homo sapiens
catttgttttaactttcagtaacttggaagttccttaagactgacaagatgtatttgtcaaagaataaatggtaactaggtggtggtggttgtcattatgaactggagttaagaaaacttaaagaaatagcaacttgttagtgtaagatttccatttgctgcatagaaaggaaagcatgaataggacaggctagcttggaagcaatgaggattatcatgattgaagtaaaggagccaaattggagatcatctgagagatgatttgatgtgagacctggaggtacttggatccctaaatcttaggctgaggagtttgagcctatcttaataagcagtgggaatatagtgggaaggtagtttgtgtgtgtgggtgtgtgtttgttttgttttgttttttgtttttttttgagacagtctctctctg

SEQ ID NO: 350554 - DNA, 450 bp, Homo sapiens
tctaaatacagcttctttgtcagatatattatttacaaatatgttctcctatgctgccttttatcttttaattctctttacagaatttacaaaattctgtcttttgaagaggagaagtttttaactttgaaagccaatatatgatttattttccttttatggattatgctttaggtgtaagacctaagaaatctttgcctaattcaagttcacaaatgttttttttttctttattattattatactttaagttttagggtacatgtgcacaatgtgcaggttagttacatatgcatacatgtgccatgtttttatcctgtgctgtcttgtgaaggttttatagtttagattttacatagtgggatgtattttgggttaattttttattatgaggtgaaatatggattgaaggtcattctttggcatgcggatatccaaatgttacagcac

SEQ ID NO: 350555 - DNA, 426 bp, Homo sapiens
ttttttaaaatggaaagggagtctatgtttcccaggctggtcttaaactcctagcctcaagctagcctaccacctagacctcccaaagtactgggatcacaggcgtgagccactgcgcccagtcggttatcactttcataagactagaaaagacagtaagactctccttctcctgtaaatcttagaaagagtgtaagggaacccaaagatgtgtcttaagcaaatactcctagagttccccaagagactggatattatcaatacatttatgtatacctggcatccaactagagcagtttgcttttacaagaaatggcataaaaattaaaaaaataaatccaatgaactttctctcaaaaaggctccctgggaattctcttacaagatgggaattaaaaaaaaaataagaaaaacaagatgggaata

SEQ ID NO: 350556 - DNA, 388 bp, Homo sapiens
gaagaagacaatgtcataaagcttatctagtgtttgtggtatggcccatccaatgaacagaaaaatcatgtgaatcccggagcttctacctagcagtaaactcactgatcttcagggtgtttctttgcaaaatccaggcttttggattcagactagaactacaacattggctctcccgggtcttcaacttgccaactgcggatcttgagacttgtcaacttccataacctccaactctctctctctctctcgctctgtgtgtgtgtgtgagagagtgtgtgtatgtccgtgtgcatgtgtgtgtaagtgacagaaagacagacacacacacagttccatttctgtggagaaccctaatacatctacctacttaagacatcgaattcct

SEQ ID NO: 350557 - DNA, 1691 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350558 - DNA, 1728 bp, Homo sapiens
tgcgacggttggattttgaaggagccaataggcgctcggagcggagagtttaagaggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350559 - DNA, 559 bp, Homo sapiens
gtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350560 - DNA, 1659 bp, Homo sapiens
  misc_feature (30)..(31): n is a, c, g, or t
caatatacggctaggtacgaggctgggtgnngcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350561 - DNA, 2621 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgaggcacttaggtgggcgcctatctaggccatgcttctcagttggccttgaccttggcaatacctggagctccattttgctgaagtgcacggggcagccgcttgcccttggtataagagtgataccagaagttggagaacagcatgaagaagatggtgccatacatccagatgaggtgaataatgactgggtactggtagttacagctggacataaagtagtactgggagatgtgcagtgagaccaggacaaact

SEQ ID NO: 350562 - DNA, 2504 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgagggaatagtccacagggtcacagcgccaggtataggtgctcagccagcccgacatcaggaactcatagacaatgtagagggagagtgccaccagtgagaagttgtagacaatcatgaagccacggagctggaaggg

SEQ ID NO: 350563 - DNA, 1838 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350564 - DNA, 1218 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350565 - DNA, 530 bp, Homo sapiens
gtacccgttgaccagcatcaaggggctgccaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350566 - DNA, 742 bp, Homo sapiens
ctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggtcagtgaggtgccaaaggaactgagtgagagcagccttcatactttctccctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggtatgtgtcccagaggggcttaaggcacgggacctgactgttctttggataataccatcttgctccttcactaccctttatgccaggaacatcagaaagcctgggctttgaacctgaacggttttg

SEQ ID NO: 350567 - DNA, 321 bp, Homo sapiens
ctcacctataatctggggactgttaaggggagaagggatggtaggattggactgggttaatctgtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtaatcttttgcctgttcctgcctctcccacatgcattcttaccgggcaactacattcactccaatggct

SEQ ID NO: 350568 - DNA, 1777 bp, Homo sapiens
ggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350569 - DNA, 1695 bp, Homo sapiens
ccacgcgtcgcgaccacgcgtcgacccacgcgtcgcccacgcgtcgcggacgcgtgggtcgaccacgcgtccggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350570 - DNA, 1823 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaaaaaaaaaaccgcggcttttggggcgagagagaaacgaggcgcatttccccctttaagggacggcctgggttttacgtattcgttcaattcccttctgtactcacaaaagcaaacatctcatcgtagcaaaga

SEQ ID NO: 350571 - DNA, 1967 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaaaaaaaaaaaaaaaaaaaaaaaaaaaaaaaaaaaaaaaaaaaaaaaaaagacaacacggcgggacgacgacacatgtcggcgggggcgggagaaaacaggagacgtcgagcaaaggtggccgacggggtgcgcagcaacggggtactctagcaccacactctttgctggaggaccagggggggcgaaaatgccgcgggcccccccaataaaagggggcagccatatacgttcccacgaagcacggggtggcccggctagtagagagaacgagaaaat

SEQ ID NO: 350572 - DNA, 1581 bp, Homo sapiens
ccatccccaatgcaccccctgcgcgctggggatgggtgcatccagagtgaagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350573 - DNA, 2538 bp, Homo sapiens
aggctaggacgaggccgggttaaatcggccgagggttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgaggcacttaggtgggcgcctatctaggccatgcttctcagttggccttgaccttggcaatacctggagctccattttgctgaagtgcacggggcagccgcttgcccttggtataagagtgataccagaagttggagaacagcatgaagaagatggtgccatacatccagatgaggtgaataatgactgggtactggtagttacagctggacataaagtagtactgggagatgtgcagtgagaccaggacaaact

SEQ ID NO: 350574 - DNA, 530 bp, Homo sapiens
tcgccgtatcgaccagcaaacagcggtggccatgccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 350575 - DNA, 894 bp, Homo sapiens
acacacaaacacacacacacgggaaggtgaccaaaagtgcaggcagcatgaggggaatttggagcacaccagggaagtgaagtacagacttgctcacactcctgcaactccctcaccctcttttcctggatctctggctttccctggatttcccgtaataggatcttccattttcacctcttcttttactccccttcaccctctgtctcatttacttatgaactgaaactggccttcatcggctggagacaagaaagatgtttagcccagtggttctcaaggtttgctgtgggggagtcagaggctgggcagtctccatttgtcctgcagagccactcacggtccttctcaccatgccccatgccctagggggctgcctcctgtgtagcaaaactacaggctctcttgcctctggcttctggtttgcagaagattggcaaagtgaggttggtgtccttatacccctattgggccatcaagcactggctgagtccctccatggcaaaattccaagcacatcctatcttatggcccttcccacagtccctctgctccagattccagtaacccatttgccgcgcgtgcccctgcatagctgcacctaggctgttaacagcgcacagcacttgtgacttctccttaccccgactacctctctgaaatggtccctttattaaaccctcctaaaattatcctaatttgagtgtgtcatcagtttccttcaggggcactgacacaacagggagcttgtctaaacttcagattcctgggtattgactgcagaaattctgaataaataggaggtcctgaggggatctacatttttagcaggtgcctaattctgatgctggtggtccagggatgattttgagagagatttgcctacaccttaac

SEQ ID NO: 350576 - DNA, 816 bp, Homo sapiens
agctgcagagggagacagggacctggtctgctccccactaccctcctggtccagtgggaaccctggccccactgagaaccaatctcctgaggagatgagccaggacaaaggtctcacttgcctgtcaagcagctgtggtgtgacctggtctgtagccccaactaccccaactagcataccctcagtgggagagacagaactcatcccactggatagtctggttcctgagatgtgtgctcctctgctcaaggattcccactgcaaggatgagaaacctgaaggatacacgggagaggctgaaggaagctggtgtacaggaaatggcccgtgggaatcttctttctgtggcctggttcaacctcaaataccaatgttctgacactggttgtatgacctagatagggtagggtcttggctttctcttgaggcctcagtttccccatttataaaacaatcaaaattgatctcagatccatccctcctagtgctgatgttccaagaccaaaagcccagaagagtgggcctagctaatgtttctgggcctcatcgtggtaacatgcacagcccttgccactcccccatggcccatgtagaaacaaccatgtggccttcactctgcccacagaagctagcaccaggaccctggtcagggttagaggtttctgctgagtcaaagccacatggagggagggagcaagggagagatgcagagtcatgtttccaggaggaggttatctgagcataacagggacagggtgggccacaggatacctctgaggctcaggttcccacctccactccacccaagccttcaat

SEQ ID NO: 350577 - DNA, 374 bp, Homo sapiens
tctggctctgttgccaggctgaagtgcagtggtgcagtcttggctcacagcaacctccgctacccaggttcaagtgattctcctgcctcagcctcctgagtggctgggactaaaggtgtgcgccaccatgcctggctaatttttgtatttttagcagagatgggggtttcaccatgttggtcaggctcatcttgaactcccgacctcaagtaatctccctgccttgatctccaaaagtgctgggattacagatgtgagccaccggtgcccagcctacatccttactttttatacaaagctcctatcgctactgtgattaaatacttatttgagaaattattaaatgactattctctcttctatttggttggagg

SEQ ID NO: 350578 - DNA, 157 bp, Homo sapiens
gcggccgcctactacttttactgctcgaattcaagcttctaacgatgtacggggacatgtggaattccctaccctgactccttccccaaacccagggaaaagagctctcaattttttatttttaatttttgtttgaaataaagtccttagttagcca

SEQ ID NO: 350579 - DNA, 3600 bp, Homo sapiens
ggtggctcacgcctgtaatcccagcactttgggaggacaaggcagatcccttgagcccaggaggtagaggctgcagtgagctgtgatggtgccactgcactccagcctgggcaatgaagcaagaccctatctgaaaaaaaaaatttttaaaaaaggcaaagatgggcctggggcaccaaatattccagaggaaagggaacgtgtgtactccttgaggtggggaacatgacccacttgaggtgcagaaagaagacttgtatggggtggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350580 - DNA, 4060 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350581 - DNA, 4435 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350582 - DNA, 3884 bp, Homo sapiens
ggcttccaagaattgcctgttcccttctccttaagggatctcgggcccttgtcatcaatccgtaccatttacattcttactttgaacctagtcctcactcttctctgggatgcattatgatccctataactttctttagcttctctttctccctcctcaatcccccaactttctagaggtttctgtctgtaggggagagatttgacagtgcccttcccattcaggatttccaactttgacacctccctcgagtttcagggatttctctgatccttgtgacatttggtctgtttttcccgtgggcttcatgtgttctctgttacactctttatctccacataccacttatttcaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350583 - DNA, 5045 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgatcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350584 - DNA, 4029 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350585 - DNA, 2952 bp, Homo sapiens
gcaccccagcgctactagcctgatgttaataaagtagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350586 - DNA, 2774 bp, Homo sapiens
ggcttccaagaattgcctgttcccttctccttaagggatctcgggcccttgtcatcaatccgtaccatttacattcttactttgaacctagtcctcactcttctctgggatgcattatgatccctataactttctttagcttctctttctccctcctcaatcccccaactttctagaggtttctgtctgtaggggagagatttgacagtgcccttcccattcaggatttccaactttgacacctccctcgagtttcagggatttctctgatccttgtgacatttggtctgtttttcccgtgggcttcatgtgttctctgttacactctttatctccacataccacttatttcaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350587 - DNA, 1756 bp, Homo sapiens
tgagcagctgttccgaaaggcgccggggatgtcccctgctgcaatgaacacaggctccttgctcctcctggctggtgatgctgtccacagagaactgggagatgttgtcacagctgttggtatccagtgtggagagagacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350588 - DNA, 2403 bp, Homo sapiens
gaatcttaaactatttttattaaattattaatagcaatttcagaccccatagcctttgttagcagttttctgatttcctttctttccactgatagctttaggtcctaggaaactggacaggagattggagttacgggcagcaggaaacatggcaggggacccccctccctggtgtcatgtggccagtgtattgctgcttaaggttccagcctcagtcagactgactactgcctcttcctctcctctattccccctcctcagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgatcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350589 - DNA, 3749 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtatcagtggtggtatcagagtggatagtggtggtatagggtatagggtggtatagtagtgtatgtgatacgatcctctaga

SEQ ID NO: 350590 - DNA, 3286 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacaggtaggtgacttctgctgctcatcctaacatttctccagggttctctctgtcccttcgtgtgtagttctcaattacttattactgccctccatggcaaagatgtgaaaaatgaaacaatgtattttaagcagagacagatgtgttcccatgacattaagtcaggaggcagactaataagaactagggtaaaagggcaaagaaatgaaggatttatgggaggactaagggtttgagtgagcagggtcttcaaggacaagggaaaatgatgacagaggaagctgcaggggaggtacatcccagctagaagaaataattgaatgtgattaaagcacagactgcactgcatggcagtggagtaggaggtggtaccatgaggcaggtaa

SEQ ID NO: 350591 - DNA, 2085 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctggaggtatcacattccctgatttcaaactatactacaaagctatagtaatcaaaacagtacgatactggcataaaaacagacataagccaacgttgagatcaggcatgt

SEQ ID NO: 350592 - DNA, 2208 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtcccctcctctcctgtggcccccttgacaggactcatccctaccaaccccccacccccccgccccggatttctggggaaaaaaagaagtgaaaggcactgca

SEQ ID NO: 350593 - DNA, 244 bp, Homo sapiens
ccctgcccgagtctggctgcccactgctggctttgaccaccacgtggtccgtgtaccccacacacaggctgttgtcctcaactccaaggacaaggtagatgggttctggcccaaacccctaccctggacgtgactcttcacccatggttgttcagagtttgcgtgtatgaccagtgaggccctcaccaacatcctagactcccttcatagttcatgatgcatatgtcaaccatgactctgtctc

SEQ ID NO: 350594 - DNA, 622 bp, Homo sapiens
gaatcttaaactatttttattaaattattaatagcaatttcagaccccatagcctttgttagcagttttctgatttcctttctttccactgatagctttaggtcctaggaaactggacaggagattggagttacgggcagcaggaaacatggcaggggacccccctccctggtgtcatgtggccagtgtattgctgcttaaggttccagcctcagtcagactgactactgcctcttcctctcctctattccccctcctcagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggagatgacactggcagagaagcgaggtagagtgagagtgagagctttgaaggccacagttaagaggaatgactcagaagggggagccatggttggagatgacactggcagagaagcgagagcaggtgtgcaggccaccattccagtagcccaggcaagaaccaggccatgagcaggttagaaccgtggctcagaacatagtggaaggga

SEQ ID NO: 350595 - DNA, 4307 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350596 - DNA, 3834 bp, Homo sapiens
ggcttccaagaattgcctgttcccttctccttaagggatctcgggcccttgtcatcaatccgcattatgatccctataactttctttagcttctctttctccctcctcaatcccccaactttctagaggtttctgtctgtaggggagagatttgacagtgcccttcccattcaggatttccaactttgacacctccctcgagtttcagggatttctctgatccttgtgacatttggtctgtttttcccgtgggcttcatgtgttctctgttacactctttatctccacataccacttatttcaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350597 - DNA, 4741 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcaccacatagaagtttgctttttccctgcctgtcttggtcactaccacctcttccctgagaagggcgggccttccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtcccctcctctcctgtggcccccttgacaggactcatccctaccaaccccccacccccccgccccggatttctggggaaaaaaagaagtgaaaggcactgca

SEQ ID NO: 350598 - DNA, 4233 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350599 - DNA, 4982 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgatcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350600 - DNA, 1835 bp, Homo sapiens
gtcttgaactcctgacctcaggtgatccgccctccttggtctcccagagtgctgggattacaagcataagccaccgcacctggcctcttttttcttattatttgaacttacagctcccattctccctgcttgagaggggatagtgaagtttcctgttctccctgcctgtcttgggcttgctacttaggtgataccttttcccacatacctgagtgtagtttctgactttgtcaggccctagacttcctttccaaactccctggtcctcactgggttaagtgagtcttactcatttgatggcttagaattcaatgctaccaaggagagaggctggagaaagggaagagttttagccttcttctccagtgtggagaaagatacagagtcctgtatcctccatgtctcctcacagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350601 - DNA, 4200 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgatcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcgaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350602 - DNA, 2695 bp, Homo sapiens
  misc_feature (2525)..(2525): n is a, c, g, or t
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagnaggtccccctaggcatactcccaagggggtccggcaggcatgcaggggggggtgcctcggaaaattggctcagggtgaacgacgggcaagggaaggaagaatgcctggacagcaaagactcgggacggaaagaaaacagaacggccaacgaaaaagccgaaatcagagaa

SEQ ID NO: 350603 - DNA, 1833 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtcccctcctctcctgtggcccccttgacaggactcatccctaccaaccccccacccccccgccccggatttctggggaaaaaaagaagtgaaaggcactgca

SEQ ID NO: 350604 - DNA, 1277 bp, Homo sapiens
gaaaaatacacaaaagcaacaccagaggcccatttgcatggcgtgtttttgtttatttgtttggcctaatatggtttcgttttgtttggaagaagggattgtgccctccaagcctttgtcgtttcactcacctctcccaacctggccctgtccagcccctccctggagggctgggcatatggatgctggaggtcacaggctgcccaggcaggttggtgacctcggaggcagaaccacggcctcgagtcgggcctctaacggcgaaaagactgacgcggttggaccgcgccattcccgaaatgttaaggagcttaaactccgcatcgtcctccaagataagtaggaaaagggcagtcagaaagaacgtcttccccgtccgccgtcttcctgcgcgcccttctaggaacccagcgtccatcccacggcctgatttactaagggagtcttgtagcatacgggagggggaaaagtcattgattgcaattacggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgacgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcca

SEQ ID NO: 350605 - DNA, 2066 bp, Homo sapiens
  misc_feature (1540)..(1540): n is a, c, g, or t
gttgctctttgttttttggcatccttgtgtgtgaatacatgataagaaatatgaggatgttaccttctcaccaatttttaaaaattgtcagttcagtactttgcttttttagtggaatggcccttagcaatatccttcttttaaatggatttcttattgttccaaagatgtggcatttccaaaagaaaattcttccatttatgcatagaaccttgaactctagtctttaaaaatctaggctttagtttcagctcttttttagctgtgtggtcctggacaggcccttttacatctagacttggagatttaaagaaaatcataaagaattaaatgagatgatttctaagactcatttcattttaaaactctgatctttcagagacgcacaaatccattccctcttgctgtggaggagaaaatacatgaaaatctgaatccatatgcatttgtcagggttctccagagacataaaaccaataggatgtatgtgtttatatagagagatttgtaataaggaactggctcacccagtcatggaattccataatctgcatcatcaagtgtcatggtctgtagctgggaagctggagacccaggagagtccatggtgcagctccagccttggcctctgacagtgctgggattataggtgtaagccaccacacccagccctgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctattcgattgcattagcgtttgaatattacccagctagttgtggagtggggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaataggcagtgtttctggagaaagccaggaggcagattttagtgctgttcagcatctgtggtctctactttctggatctggtgcattatggagaccatgaaatgacatgaaatagctcagtgctgccagtggcggtgacagggacactagaggtgaaggagggcccttggggcaattccagcaggtgggtggtggctgaaggtccttgtcttctttctgcagagactggccacctgcttcattctttcaagaagcaccaaatccctacttcagtactttgcccactcgtcatgtcaggagcatgaaactcacgaggccttcatttacttttatcctgtaacaccttcaatttttcccacatcctcccttgattcgtggatggacaactatggaggccaatctggctgaggtgangactgcttgagtctaaattcctctctcctcaaacccaattcaaactggcctgagcaaaatgaatgtattgatccataactgaaaagtccagaatgatcaggcatcaggcatggttgcatccaggggcccatgtattagaaccatctccttccagttctgggctctgcttgcctcccagttggttttactgcacagaggcttattcaagtccagagagatcttatctttccctacaagtctgtgaccttgattctgaacctgcatctatgggaagggcttgcagtgtctgagtgagcttggactgtgtaaactttcccacttctgaagctgggggtggggttcactccactaagctacatggctctagagtcagggggttgccccctaagtaactggcagtattgttaccagaaaaatcatgaatggacactgagcagaaaactcagcagatgtttatttcctggtctttaggatttgttgaagagttttttatttgtttgttttttaagaaagactcaaaaggaaa

SEQ ID NO: 350606 - DNA, 564 bp, Homo sapiens
tgcccatgactttaacataagtagtgatgttttaaaatgaggatatcatttacagtgtttaaaatgatattttataccaggccagctcaaaagacaataaaattttacttttctttcactattgtcaatttatttatatagttctatttattttttaatccatatgtatttgtatgcctgtgcatagaaaaacttactcacttgaaaattttcaacctggaaagaccattataaacatctggactaggaaggtcttgaaattagaaagacatacccatatttggcaatcgaaaaagaaacatttcaagcttatcccatatcgccttctccgggcagtctgcacagagcagttgacaactgaaaacataaaacctaaactttcagacgcaatttttaggcactagaattttctgtttgaggcctttttgccactcagggaaatggccgatgaggaactggatgactcctcatggttagctccccacacaatcaactcagtggttgctaaagttttagtgtgtaagttagttacatagtgatatttaaaacctcacttagtgtgaa

SEQ ID NO: 350607 - DNA, 860 bp, Homo sapiens
tgcccatgactttaacataagtagtgatgttttaaaatgaggatatcatttacagtgtttaaaatgatattttataccaggccagctcaaaagacaataaaattttacttttctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaagggggggggccggagcaaaaatgcgtcccctaccgggggaggcagacaacagatgagagggcgcaccacaccagcggtataggtgagacgagagggcgcccaacgaaggagaggaggagactaaaataaagaagaagcagcagggagagagcagacgaacgacacacgacacgaggacgtgacgagagagcgagaggcaacaacaacactggcccagaaccgcaggagagtagcagcgtaagaggaggacgagacaacaccacacgcacgacagacgggggaggcgtgcaacaacacaacaggcggaggagacggcaccgaaccccaacgaaaaagaagaagatcacacgccaagcgcggagaaggaagaaaaagcaagaaagaaaaagaacgtggcgaagcaagagaaagccgaaaatcaacagaggcatgagcacgacagcaacacagacgcagaggcgccagacaaacaagtagaaaacgaggcagagaagaggacagagaaggaaaaagaagaagcgagagcaccagcacacagggggagaggacaagatcagaaggcagagaagagaaagaaaatagacactaccagcagacggcaggaggcaaacaccagtgaacaagaaagcagcacgagggc

SEQ ID NO: 350608 - DNA, 2693 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaa

SEQ ID NO: 350609 - DNA, 990 bp, Homo sapiens
aggcacgaggtgcctgatgatctgtcactgtctcccatcacccccagatgggaccttgtagttgcaagaaaacaagctcagggctcgcactgattttatattatgaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtaaattccagctgttttacacaattaccagacggattgggtagaggaaattaggaaggaaggagggacagttaagggtattataacagaacaaatgaaaatttcaaa

SEQ ID NO: 350610 - DNA, 800 bp, Homo sapiens
gcaaataaacgtggcgggacgtatgtgtcatggcgctctccatctaaagtctgtgcagcttccggagagtggcgggttgattttctcactttggactggtttttacttcccgacttctggtggttggttactcgcactatgcagacgtgttgcggtgctgaatacaacatttattactaaagccagacactggatcaccgtcacggcagatgtcagcacacctgttgtaatcaactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagttatttcaggttgagtgtacgtttgcttcgtcttcaaagtagaaagttcctggagaagacctactctttctggaactgtttttgtttgacccatgctatgcaaacttactcattcatgcaaacactgggtgctttatgcaaatattaccacctgtattttttatttgtgtttctcaaaggagttttggcaaaatttgcataatgacttggctcatttagctttgtgtattgt

SEQ ID NO: 350611 - DNA, 3024 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaa

SEQ ID NO: 350612 - DNA, 2589 bp, Homo sapiens
aggcacgaggtgcctgatgatctgtcactgtctcccatcacccccagatgggaccttgtagttgcaagaaaacaagctcagggctcgcactgattttatattatgaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaa

SEQ ID NO: 350613 - DNA, 3564 bp, Homo sapiens
  misc_feature (3445)..(3445): n is a, c, g, or t
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaaaaaaaaaaaaaaaaaaaaccgcgcggttctcacggccggggcgcgggacaaatggaagaaggctactggttctatttggtccgcatctttttcggcaaggcgtgaaaccgggttcccaaggtttcgttaatgcaatatgtagcatcttcgcacacacacaacaccacacacntaaaaaaaacacacaaaaatcaaactacacgacaagagagtacacaaaaacgagacaaaccatacacaccacacctacaacaacaatcagaaaacactttataatatcctacgacataa

SEQ ID NO: 350614 - DNA, 2093 bp, Homo sapiens
  misc_feature (1974)..(1974): n is a, c, g, or t
tagaagatagagtccactttgtaggggatcccagaacagaaaaatgacattgagggacaatgaggaaacctggataattaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaaaaaaaaaaaaaaaaaaaaccgcgcggttctcacggccggggcgcgggacaaatggaagaaggctactggttctatttggtccgcatctttttcggcaaggcgtgaaaccgggttcccaaggtttcgttaatgcaatatgtagcatcttcgcacacacacaacaccacacacntaaaaaaaacacacaaaaatcaaactacacgacaagagagtacacaaaaacgagacaaaccatacacaccacacctacaacaacaatcagaaaacactttataatatcctacgacataa

SEQ ID NO: 350615 - DNA, 2063 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggtaagtaaaagatgctctcctctctaccctgctagtaaaacagcagctgtggaagcacagtgattccaggccatgtttctgttatcatttatagttccctttttatgtatgcatgaggctttaatcctttctgacagattgaaatctgaattagaaagatgtgtttttgctgatgccgatagctttgcttctctggctgtaaagagaataagctctttctgcttccagtttagaagcagggggtaaaagccattatttgcaggtgaaaatgttgacaccaaaagatgatctgatccagtatgtttctatgtcagtagatcctgagtggaaggggatgaagaaaggg

SEQ ID NO: 350616 - DNA, 1073 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaaggtaagagtttctagaattatatgtgaaattagtcttcttaataaattatgttagccttctaagtaatacttcagtttagagaccaacttctttagttttctgaagagttttacaaatatacgaacttaattaataaaagatgtgaccagagttaatcactta

SEQ ID NO: 350617 - DNA, 3092 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtaatcgttgaaagtgagataaacagatgtatatattttctgaactacatagtagaaacaccactcaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaa

SEQ ID NO: 350618 - DNA, 3202 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaagagttgccctgaacaagctctcttttttcctgccgtcatccatttaagatgtgacttactcctccttaccgtccgccatgactgtgaggtctccccagccacatggaactaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtaatcgttgaaagtgagataaacagatgtatatattttctgaactacatagtagaaacaccactcaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaa

SEQ ID NO: 350619 - DNA, 2295 bp, Homo sapiens
  misc_feature (2176)..(2176): n is a, c, g, or t
tgttttgctttcagacagggtatcgctctgttgcccaggctggagtgcagtgctgcaatcttggctcactgtagccccaacctcctgggctcaagcagtccttccacctcagcatctcaagtagctgggactacagaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcattttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccagcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatggaattggtatactaagcaaaaaaaaaaaaaaaaaaaaaccgcgcggttctcacggccggggcgcgggacaaatggaagaaggctactggttctatttggtccgcatctttttcggcaaggcgtgaaaccgggttcccaaggtttcgttaatgcaatatgtagcatcttcgcacacacacaacaccacacacntaaaaaaaacacacaaaaatcaaactacacgacaagagagtacacaaaaacgagacaaaccatacacaccacacctacaacaacaatcagaaaacactttataatatcctacgacataa

SEQ ID NO: 350620 - DNA, 1035 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaaggttctcttcacctgctgctctaccagaagtaactgctgccgtgaatctgttgtgtatcttttttctctatgtgtatgttttgtaagtttataatattaaataatggttttatactctcaaatat

SEQ ID NO: 350621 - DNA, 1147 bp, Homo sapiens
gcaaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtaatcgttgaaagtgagataaacagatgtatatattttctgaactacatagtagaaacaccactcaggtcactctgtgagactgctgggtcagaaaaaggataatggaaggcggcttgggggagcacgattggatttgccgaagattaggaagaatccactgatagaaatcatttccatcaataccggagataagatctcactttgttatgttgcccaggttggtcctgaactcctggcttcaagcaatcctcctgccttggcctcccaaagctctgggattacaggtgtgagccaccacacctagccgggacatcaatttgttaaacaaatgtagttgaacataaaaagatgagttcatgtggtatttgcccttgagaatcccatagaaaagcacaaaacaataaagttataagcaacaagcacaaaacaataaagttataagctcacattgtatgacg

SEQ ID NO: 350622 - DNA, 540 bp, Homo sapiens
tcttatgtaatagtagccagtttgcaggcactcaaacctcttctcccctcatgccactgcagtctgtcagttgaatctgatagcaaatgagcaaatttaagaaagaaaaatcagtactacaacttacttaacctaactctttcaacttcaaactttctcacctgcaaaatgagggcaaaactaattacatacctcatgaagtgcttgtgaggagtaacttagagcagattgaaagtttccttaagaggagtccagagcatttgttaaaagtactatgcccgtttaaggatcagtgttagatctgacagagtagtaatggccccagtcccccaaatggggtcacggagaagacaaatcattgccaaagcttagttttcagccttagtaatctaaagaaaggagagacgtaaaacgtttagctcaactcttcatgtttaaataaaattctgagtgacatagcatataagacttgtatttgtttttgaagtattggggcatttggaagagtttttccttcttttttttttaaactgaaataat

SEQ ID NO: 350623 - DNA, 2314 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaa

SEQ ID NO: 350624 - DNA, 703 bp, Homo sapiens
  misc_feature (32)..(32): n is a, c, g, or t
accttacggctaggtagcgaggcctgggtgtngcgcacccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaa

SEQ ID NO: 350625 - DNA, 745 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagaggtaagattattgtatgatagtatttggttacttttgcaggatgaattttcgttttaggcttttactttgacccagtttattattcataatgaaattttcatttgatagtaacagctggataataatgaagatctttcaaatttagataa

SEQ ID NO: 350626 - DNA, 6514 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttcagttaatttgtcttctgtaaaataacactgctggatgttcaaggggacaatccctatgagacaagtgataatggtttgtgcttccaaagcacctttcatccagagatttcaaagcatgacaagtaactaactaattttcttgcagcatgctttgaggtaagtaatgaatatagccatcatttccctttcttgttgaaatatggctaactctttaataaatcacagcatctgtttagtatctgcagtttgaatgctaagagcaccgtggccttcttgtaaacaacactaggtgctagagaaaccagctggaatttcaggaatgagcttgaaaccaggaccaggagtaaggtaacagcccttcctcgggtagaggtttgaatcaaacacttaataggatcttagactctggaccactgaatcccttaatgagcagggagtccgtgaagaggagccccaggttctaatgaccattccacaccaactgtgtgtttttggcaagttatatttcagattcctgttaggcaaatgagattcataaaacttgctttaaaaccatactgggactattcagtgataaatatagacatagaaaagctttgacggaaagtaccctcatttattatatccagaacttgctcttcctgtgccatctaaatcattggtatctatctcccatctaatctttggtattccaggttggctgtgcaggatttacttcctaatgtccatgactggagctcaaaagaactgtgggcctaggacctttgagctttgcctgaaagtgacagcagttctctcggcggggccagcat

SEQ ID NO: 350627 - DNA, 5906 bp, Homo sapiens
tggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaagggcagcttctccagctcccagttctggcagtgcatggtaaccttcagtgcccagctgacagaagcttccctcagcatcttctctaagtggtgtgccactggcaaggcacctgaccatgaacggcttcccccagcaccccatcacctgaagaatttgcagcaagtttcaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350628 - DNA, 5583 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaagggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350629 - DNA, 1650 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggaccgccgcaggggtttgtccctagtcacgacgattataatacaaccgatctgatgtcattgcacgatacgagctagtctgcctgtatc

SEQ ID NO: 350630 - DNA, 3492 bp, Homo sapiens
ttagcgtggtcgcggccgaggtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350631 - DNA, 3490 bp, Homo sapiens
taaacaagtgttttatcacacaggcagtcttagatttatatacaaaagtaaaactgaaaatatagttttgttctctgtacatttcttttaattttttccctaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350632 - DNA, 3265 bp, Homo sapiens
cccacgcgtccgcggacgcgtggggaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350633 - DNA, 1325 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaagtacgtatgataaacttatttcacttattcagctattttgttaaaggttagagtagtattttctcaactcaagaaattttagaatttgtttattcactggagcctgttgtgtagttcttagagtagttctgatatctttgtcatgagctatattttataatctatattttactaatcttaaaattaactttgtgaagtcagtgcacaaacatggaagaatattattctacaacttcataaaatcaatgtttaaggaattctgggaa

SEQ ID NO: 350634 - DNA, 774 bp, Homo sapiens
gtgtttgagatggactgtttgttgtttcatatatacttataattcttccccaagaaaacaaaatattcttgagagcacatcattacgttttgccatctacatagcactcgacattctcctggagactcagtaagtgcttgataaatacctgacagtttcatcaaaacagtggaataaagtgaggtgtggttttccctggtgtatactttatcctatatttcttataaccaagggtagaagtcaatgaatttatgaatattaattttaaatttctttggttacttaacgttaaatgattaaatttgaagtttgaaataataggattataagtgagctggcctttatttgcttaagtaaaccataagaagggggttataataaagtgtcatttaatagtgtaaattatattattggaatactaatgttttacattttgttttttctctaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggaccta

SEQ ID NO: 350635 - DNA, 361 bp, Homo sapiens
aaagctgatctgtgagctgtggattttagtaaataacccttgttgtagactttccatagtcattttgtttgatagccaaagaaatactgtcattttttaacctatggatatttcacaggaaatgtgtttaatgttcttctacattgatgaaaagtcaacactgtatgctttaaatcagcatgcctacctgttgtgttctaggaaatttttgtcaaagcttaaatgttgaatagcaattatctaatatttactttttctccctttttaaagcttggtaaaatgcggctgacaattccgtgtcgggcccttacatgttctcatctacaatgttttgacgcaactctttacattcagatgaatg

SEQ ID NO: 350636 - DNA, 644 bp, Homo sapiens
catgcttaaccaaataattggcagtatcacgaagacaactacagggtgatagtcatgattaccaactctacattgacagaattatttattttaaacctatttacatatacttattaatagggtgaaaggtccagtttttatagttttcccttttggttgtttttaaatttaccatcttttaaatttatctatttaacaataatactaatgaagtcatcctttaataaaggaaatttaacttgtcctttattgtttaggttttgtttatcagaaaccagttgtccacaagaagatcacttcccacccaatctttgtgtgaaagtgaatacaaaaccttgcagccttccagtaagtcctaagagctgttttttaaaattcattgccaacataactatcaaataagtcatcacaactgttgttaaatcatagtttttccttaagaaaacatttttattttggatatatattcattgactgggtgaaacacttgtaccaactatgtacagttagcagcagtgacattagctttggggacataggatttggagttgggtatggtagctttagtgttgtactggattttggggcgaagttttttcaacaaaatctcagctgtgttcatgtgagtctataagcctatggta

SEQ ID NO: 350637 - DNA, 316 bp, Homo sapiens
ccactgttggttttctactctctggctccaacaatattgtgaatctaaactgtaactgataaactgtagtgacactgagaaaagagagatgtcatagctcttcccttgccttgtattttaatcattcccatataggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaagg

SEQ ID NO: 350638 - DNA, 540 bp, Homo sapiens
gctcaactcttcatgtttaaataaaattctgagtgacatagcatataagacttgtatttgtttttgaagtattggggcatttggaagagtttttccttcttttttttttaaactgaaataattttttcttccacaggattagatttctttcctttcttatcaggagacaatcaggtatgttatgaaaaatttactattattttaattgtacattaaaaatacagtcatgcgccacataatgacattttggtcaatgacaggccatatatgcattccataagattataatggagctgaaaaatccctacatcaattatagccatggtaacattgtagcacaaggcattactcacatgtttgtggtgttgctggtgtgaacaaacctatgctgtcagtcatgtaaaagtatcacacgtataattatgtacaatataacgataataaacaactctgttactggtttatgcatttactatattttttattgttattttagagtgtacctctactttttttttttttaagtttgctgtaaaacag

SEQ ID NO: 350639 - DNA, 872 bp, Homo sapiens
  misc_feature (780)..(780): n is a, c, g, or t
  misc_feature (850)..(850): n is a, c, g, or t
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcagaaattatctgaatacacgaagattataggagtcattttcaaacaaccatcagacaacagtcagcgctttcgagaaacctgttttgcatttgccttgacaccacaacaagtgcagcaaatcagtagttccatggatatttctgggaccaaatgtgacttcacagtacaggtccagttaagttgntatcagaaacacgtgtcacaggaggacaacttccacccaatctttgtgtggtgaatcaataccctgcagnctttcaaggtaactttcacttc

SEQ ID NO: 350640 - DNA, 5703 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350641 - DNA, 4086 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaccccatcctaaaaaaaaaaaaaaaaaaaaaactccggggctctctttgtcgcgggcggaccacggggtttttgatggccctggtcatagctggttccggacccagtttttggtccaggggaactgggcggcccaatagggcgatattcgaagcgtacgtttttttcacagca

SEQ ID NO: 350642 - DNA, 3282 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaatgactaagggtcaaacacatcttgaatttcaactgtttatcaaatagtagacttctacaaaaatgtggtgcattgtactttccaaacaatttatttttagactaactgaccgtgtatctttcttttttgtcgacgc

SEQ ID NO: 350643 - DNA, 5649 bp, Homo sapiens
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350644 - DNA, 5861 bp, Homo sapiens
tttgtgcccacacttgaggcacactagtttttgtctggagtccaggaggaataaggtctcacaaacgaattgaaggtggtaaatgtgggggatttcattgccaatgaaagtggctctcagtgagaaagggagctggaaaggggacggaacaagaaggtaatcttcacctgagattctccagccatccctgccagactcctctcttcagaggatgataaaaactatatgcctacatttaggatgagtctctctctccgacatccaaccatactctccaacatccagctccttctcgtctctctcccagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350645 - DNA, 5771 bp, Homo sapiens
  misc_feature (1951)..(1951): n is a, c, g, or t
  misc_feature (1966)..(1966): n is a, c, g, or t
  misc_feature (1973)..(1973): n is a, c, g, or t
  misc_feature (1980)..(1980): n is a, c, g, or t
  misc_feature (1983)..(1983): n is a, c, g, or t
  misc_feature (1991)..(1991): n is a, c, g, or t
ggcggaggccagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctccagatgttctgtcagtagtcgaaaaaaaggggggggggggggggggggccccccccaaaaaggggggttttnaaaaccccttttttntcctttntcttttnggncccccaanaaacccccccaaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttca

SEQ ID NO: 350646 - DNA, 1429 bp, Homo sapiens
ctgctgctgtgtgtccgctccggggtgtgtttcgcccatatagccgcccgtcgtgtccgtgctggtgtggtggtgctactctcctgcgtaggggttgtggccgccaggcggcgagtctcgtgttgggtagccgttgtctgcttgtgggcggctgatattggtgtccgcgttggtggcgccgtgttgggcgaggccgagcggttccgtctggtgcgcgtcgcgccgtccgcgcgccgatgtcccttgtgggggggcctgttccggataggtgcatggtgtggggtcgtgctagttgggtttggcgttggttttgtggcgatcattgttgcttgcgcgtttgggaccatgtgcgctgtcgtccttgtgcgtggagtggctgagctttggtatgccactggtccgcaatttcgtgtgggtggccgctgttcggcaggtgcgcgtggcagtggggcccatccgtcggggtgcgcgtggctcgcatggcgcggccatgtgtagcgatcgttggcggtcgctgcgtagtggtccgctcggctgtggcgggggtgcagtgcccaggtgtgtctcagtagtctgcgagtcttgcgtgccggtggagggtgcaggcgggccggttgcagtgcgtgagggaatggagaacacagcgcgcagcgggaggcagggcaatggcgtgtccgtcggagaagagagaaaggagggtgccgccgctgggtcaccgcggccgcgcgcgtgcttgggcccacgcgtcttgcgagggcagggacagggccaggaaagctgactgtgccggggacgccttgacctagggcaccagagaagcgggcacgggtgccgggcccacaaccgggacaggtacacgagaagttggccccaggttgggcccgcctcgccctgcctcgcccacagccgccggcacagtaggaggcaccccgcccccgtgaacccagaggtccctgagctcgctcacctgcagccgagtcaccactaggctgtaggcgacgctgggtcgacccacgcgtcggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350647 - DNA, 678 bp, Homo sapiens
tcagagctgtgcctggggccgactttgctgctcagcaggaggtgggagtttccaaaccctgcgttctttaccagttgcttctgccctttttaggagctgaaggagagcctggagggaggttgaaattgactttggagccactgatggctcagaatctgggctcaggtgtgagtaacctggcagttttgggagtgcccagttacaggacagctgctgctgcccccctgtgggggccatgctgtgaacttgcaggagacaaagggagggtctaggcttgcagggggatgtggcatggagcagccacacaggcccccaggtgtgctggcacctgagggtgacatgggagcgcactggggccccggtcagcatcactgatgggctgtcttcatttccagtccattttcgctgcgtggtgtttcatccattcctagatgagattctcattgggaagatcaaaggctgcagcccagaaggagtgcacggtaacagtggccctgacgcctcagacaagacttgggaacactgtgggggcaggaggtctgtgtccacccacatggtcaggggagggctcaggtgtcgaggccgaaccttccccgtggtgtcagagaagcttgcccaccctcccttttatgtgttgtgtgaggacctccatcagcagtgcggtttcactgtgagccg

SEQ ID NO: 350648 - DNA, 4480 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350649 - DNA, 4469 bp, Homo sapiens
  misc_feature (44)..(44): n is a, c, g, or t
ctcgcccgcagtcgcgcaagcgcgagcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350650 - DNA, 4196 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350651 - DNA, 4535 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacggtaacagtggccctgacgcctcagacaagacttgggaacactgtgggggcaggagtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350652 - DNA, 3939 bp, Homo sapiens
gtgtcatctggtatctcttcatattcatagtcatcttcagatgcttcagttatggtgacctgttccaggtagtaggcgccctcagcctgccaccgctgtctgcctgtgtccctcgctgtcccggctgccgtcaaacccatgcccaacgcctcttccaggaccctcacggcggagctgggcatccctcgctgagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350653 - DNA, 3061 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacaccaaaaggcttgtttttggtcggtgccaaacacaagccatcccatatccacgggtgcccaactgtgggggcaggagttgtccatggcttccagagcctgtgtggacgtgccaggtgtggagcctgctgtgcaatcacacacactgtcccagcccagcctgagctgtactcacctgcccacacccactggaggtggctctgatcagctgctgctggatggctgagggccccagacggaggctggccagatctagctctgcccagtt

SEQ ID NO: 350654 - DNA, 845 bp, Homo sapiens
  misc_feature (55)..(55): n is a, c, g, or t
  misc_feature (772)..(773): n is a, c, g, or t
  misc_feature (780)..(780): n is a, c, g, or t
  misc_feature (782)..(782): n is a, c, g, or t
  misc_feature (795)..(795): n is a, c, g, or t
  misc_feature (814)..(814): n is a, c, g, or t
  misc_feature (819)..(819): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcagtgtggttnnggagtcnanacgggaggagccngactctactgcccgggagnaaccntcggggtggccaacttgtgagtccca

SEQ ID NO: 350655 - DNA, 491 bp, Homo sapiens
gcagggcttgcctgtcaagcataagaccccgcagtgtttggcgtccactgggacccccatctcaggccgtcacctgcttccttccttccagtctctctaggcttcttcgatgacattctcatccccccagagtcactgcagcagccagccaagttgtatcctccaagggttaaagtggtttgtcacagggagctcaggcctctccaaaggaaggtccccactccttagggtggcctttggggcctgtaacctgatgtcactggcctctgtgcctgcccctcgcctgtgcttttgctccagaggcaccagcctgtctgtgcctcccatgcagggagtcatgtgatgcccacatgcctgtctttgtcggggccatcaggcttggctgtctgggttgtacactgcacaccattagagctgtggtgtcctgggggacaccattcacttccggttcacttcacttaggttgtccctgcaggaatcatcttaaagat

SEQ ID NO: 350656 - DNA, 4746 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacaccaaaaggcttgtttttggtcggtgccaaacacaagccatcccatatccacgggtgcccaactgtgggggcaggagttgtccatggcttccagagcctgtgtggacgtgccaggtgtggagcctgctgtgcaatcacacacactgtcccagcccagcctgagctgtactcacctgcccacacccactggaggtggctctgatcagctgctgctggatggctgagggccccagacggaggctggccagatctagctctgcccagtt

SEQ ID NO: 350657 - DNA, 4304 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaagtgttctttcaggcttctttcgatgcacatttttcattcccccccagagtcaattgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350658 - DNA, 1452 bp, Homo sapiens
  misc_feature (55)..(55): n is a, c, g, or t
ggacgcgtggcgcaagcgcgagcggctgtgcgcggtgcggcggtgcgcggtgcgnggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccac

SEQ ID NO: 350659 - DNA, 1566 bp, Homo sapiens
aaaacataaaatattcataagtagaatcactgacagtggcagctatgaacaaaatcttccatatattcccataggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttctt

SEQ ID NO: 350660 - DNA, 1777 bp, Homo sapiens
cagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaagtgtttatgtttttaactgttcaggctgttgaaaatcctacagctacagagattcaagatgtatgttcagcagttggacttaacgtatttcttgaggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttctt

SEQ ID NO: 350661 - DNA, 1866 bp, Homo sapiens
cagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttctt

SEQ ID NO: 350662 - DNA, 381 bp, Homo sapiens
acttataaagcattcagttttccaaatttatttattgctttgggcctgtggcttctgcactttgcaataagcttttaattaaacagaaaaaaaaatggatgtcttttatccttttgtttctttgaaaactgttttgtagttttgatgcagtccatttagttaaaaaatattgccatgtctttatgatcaattcctttcacttatttgattaaatattaaaattgcatcattatttcagtgcgtattgtacaatactggggagcccgttgtgagcttctgttgtttcattttgaagtatagcccattgttctgtcatgccaaagaattgacaaaacaaataataacaaaaattctccccaaaccttgagtgatgaaaaaaaa

SEQ ID NO: 350663 - DNA, 6036 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccacctcccgagtagctggggctcaggcgtgcgccaccatgcccggctaatttttgtatatttatggaaatgccaagagatagttcaatctgcctctctggcaagccatggacaccaggtctgacaaactctcttactccttaagacaaatgctcacctgatcaatatggggaaataagctgcatggtaccataatttctattctaaaagggaaaagtatctctttggtattgctttggaaaacattctttataactatcttgctatttaaaaattgacaattatccttccataattaaaacaggtagacaac

SEQ ID NO: 350664 - DNA, 6165 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350665 - DNA, 4242 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatga

SEQ ID NO: 350666 - DNA, 5740 bp, Homo sapiens
tgccaggtatttaaaattatcggatatatttttccagtgaccagaaagaaaatcctgatattttttccaactttgaaggctctcaggaggttggagggtggggtttcaggggacaggaagaactcctatacaaccaaccatgaagaacctttgagcttaggacccccagtgggatgctggcagcaatattgctgttgggctgagagggaaatgtaaaaatctttcacgagcttcctgttaacgatgacttttctgtaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350667 - DNA, 6127 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgagctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350668 - DNA, 6136 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350669 - DNA, 4095 bp, Homo sapiens
tttgccctcacttggtgaccttcctctctggggatgttttagatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350670 - DNA, 3365 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttatgtctttaatcacaagacttcccgtcgatttcagcactcccgcccctcgcccct

SEQ ID NO: 350671 - DNA, 594 bp, Homo sapiens
cggccgcggtctacgaagaccaagtgggcaagtttgattggtgcgtacgtgtggaacatattcgagagataagtggctgtttccccagtacctgtctcctacctgctaaaggttgtcacttaacaggattggccgcataatttgcaggacccagtacaaaatgaaaacgtggggccccttgttaaaaaattattaaggatttaaagtcgttggaagcagagccttaaaccaagtgttaggggtcattctaagctgatccttgcgtgtaagccggccctgccatccaggaatgcttggggtgccggtcagagatcactgatcccgtcctccctcgtcaggttcgatttttttgactgtgaggtttctggtctaccaggtgtcagaggtcgccaagctgtcagtgaactttaattcctactcgaattggtgtcttgtaggcaagtgaacaggagctttcgtcttaaaagtcctaaactgagtccttttcccctctcatcaacctagtctggccctgggctcacagcaggattgcccaaaacactaagcagctagaatatgccattcactcattcattcattcacccacccacgtct

SEQ ID NO: 350672 - DNA, 396 bp, Homo sapiens
tcttagtcttctgggttgccaccttttgttcatagtaatgtctaactttcatgtctctcagtgtggcgccatgttgacaagggcacggcagaaggggctgtggatgccatgctgctgcacggacagggtaagcagagtcctcccgtgtctccattgtgcggccagctccctgtcccattccttggctccttgatctgtacagggtctggtagggaaaggagactggggactcctgacagtgaaggacaggtacctgtttaacatgtatttgcatccagaaatcagaggtgaggccactgctcacagtgggaccctaggaagcgacagagcaagtgggaaatgacttcaccacgatcttttcttttccagatgtgatcactgtgtccaatggaggcc

SEQ ID NO: 350673 - DNA, 367 bp, Homo sapiens
ggagagcaggaattagcttagtggttcagtgtgttggctttaaaatggtcggctttcctcttgtggtgtgaagtgccagtcatctgtatgttctttcttttcagatttagaacaaagtaggaatctagatctcagtcttactctccagagagcttcctttcttgtagtccttcctaacattcagctgctaaatttttaactacctaatgcaagcagacctcctaggagatttgaggctagatatgtagcctggaaacctcccaggactcaggaagggcagccaagagatccctttacagcagtgctcagactgcctgtcccggctggtgttttgcagaagaggagaacttaatcccgtattctccag

SEQ ID NO: 350674 - DNA, 412 bp, Homo sapiens
tgaccattctgctccaaagtggggagcactttcaactctaaggccaagggccttccctggagaggtgaccctctgtaaggcagctggctagtactggtcccatttaggagctgatgccttgcttttcccccagactgccctagtgagctttgccaccactggggagaagacggtggctgcagtcatggcctgtcggaatgaagtggtgagtattgagaacaacagtcagcacttgggattttccttcctggtctccactaggaaccctgaaaatcagaagtctgggcacattgacctggtcagtttgaacccagcgggcaggaggctgttgagaagtgaggtcttgcctcaactatagagctttctgcacaccccatttctccccaggaacgagaccctaatgtgatgacct

SEQ ID NO: 350675 - DNA, 333 bp, Homo sapiens
aggaggctgaggtaggaggatcacttgagcctgggaggtcgaggctgcagtgagccatgaacatgctactgcattccagcctgggcaacagagtgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttat

SEQ ID NO: 350676 - DNA, 495 bp, Homo sapiens
cctggctcatttttctagttctgatctctattccttcctgcacaaaggcctcaaataatgaactgtaggatgtgtctaactccagctgtttcagttctaagtgtaccctcctgattacaggcttttttgcccctgccctaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaaggtacatacagccagctgtctggtctacagcaagggctttcgaatcaggaaaacaagggcttcaagtctggctgtaggacttggtacatatatgaccttgagtaagtcatttaatccctttgagccttaatttttgtttgtgaaatggggataatataccctcctcctgggcttgttgtgatgatcacatgggatgttcatgtctagcccagtgcct

SEQ ID NO: 350677 - DNA, 922 bp, Homo sapiens
acattttgacttttttctttgtgacgttagcctaggggactattcacctacagccaagaacttattttccacaaagagggcaaagactagagaacccccacagttgttgagctggagtcccagctcttcaggtctatccctaggatttgcagtcttttcttgttggtggagcctgacagtttgctcattttaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtactgtcttcagaggggatggagaacatgctagcggagtccggtttggggccaggtggtcaaacacagcggcccggagatggagtgctctctgcacccagcacgtgtttgggctctaaggccatcccgaagagaaatgatggctgtgtctgcatttgtgaaaactcaggttcttaacagaactgaatgtaaaccctaaactgagttcaaatcaactgatttgcagttttattcttaaggctctctttgatggggaaatttcctaactctttccttgggctctctgggtttttcaaggtcacagcttttccagccactcggaatgtcttgcgacagctacatgagcttgccccttccatcttcttctatttggtggatgcaggtgtttcctggccatttggctaagaagtgaattatgctactcattctactgtaaacttagattagcataatcctgatgtctgatacaaagtcaatcatttgttcatatttgttgggcagctactacatggcagatacggttctaggtgctgtggatggagtggtgcacagtagaacaaatctctg

SEQ ID NO: 350678 - DNA, 5893 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatctgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350679 - DNA, 6680 bp, Homo sapiens
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacaggtaactgcaggcaacatggtttgctaggattcaggagatctctccaagacatggatgctagaaggcagtgcttttgaatctggaaacgtttgctcttaggcccaagattgatgacaccttcccgtaagtggtttgagagggggtaggtagccttatcatagaaatggtgtatttcctcctgagtattacaaaggatctttagagcaaaactagtgccttccttagtccaaaggaaatatggggacataaatgagagcttccccatagatagtaagaacaagcagcatgggatttaagattgacctgtgcctgcgttggaggtagggagagttctgttttcagctgtagatgcaactgaggcctccctctgctcttaaatgcctgaccattctgctccaaagtggggagcactttcaactctaaggccaagggccttccctggagaggtgaccctctgtaaggcagctggctagtactggtcccatttaggagctgatgccttgcttttcccccagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350680 - DNA, 6255 bp, Homo sapiens
tgccaggtatttaaaattatcggatatatttttccagtgaccagaaagaaaatcctgatattttttccaactttgaaggctctcaggaggttggagggtggggtttcaggggacaggaagaactcctatacaaccaaccatgaagaacctttgagcttaggacccccagtgggatgctggcagcaatattgctgttgggctgagagggaaatgtaaaaatctttcacgagcttcctgttaacgatgacttttctgtaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacaggtaactgcaggcaacatggtttgctaggattcaggagatctctccaagacatggatgctagaaggcagtgcttttgaatctggaaacgtttgctcttaggcccaagattgatgacaccttcccgtaagtggtttgagagggggtaggtagccttatcatagaaatggtgtatttcctcctgagtattacaaaggatctttagagcaaaactagtgccttccttagtccaaaggaaatatggggacataaatgagagcttccccatagatagtaagaacaagcagcatgggatttaagattgacctgtgcctgcgttggaggtagggagagttctgttttcagctgtagatgcaactgaggcctccctctgctcttaaatgcctgaccattctgctccaaagtggggagcactttcaactctaaggccaagggccttccctggagaggtgaccctctgtaaggcagctggctagtactggtcccatttaggagctgatgccttgcttttcccccagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350681 - DNA, 4826 bp, Homo sapiens
acattttgacttttttctttgtgacgttagcctaggggactattcacctacagccaagaacttattttccacaaagagggcaaagactagagaacccccacagttgttgagctggagtcccagctcttcaggtctatccctaggatttgcagtcttttcttgttggtggagcctgacagtttgctcattttaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtactgtcttcagaggggatggagaacatgctagcggagtccggtttggggccaggtggtcaaacacagcggcccggagatggagtgctctctgcacccagcacgtgtttgggctctaaggccatcccgaagagaaatgatggctgtgtctgcatttgtgaaaactcaggttcttaacagaactgaatgtaaaccctaaactgagttcaaatcaactgatttgcagttttattcttaaggctctctttgatggggaaatttcctaactctttccttgggctctctgggtttttcaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350682 - DNA, 3456 bp, Homo sapiens
aacgcctgcaagggaccgggtccgaaatttcccgggtgggccaactactactataaaattcggggcccgggtggaccaaacaagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtgagccgagatcgtgcctctgcactccagtctgggcaacacagtgagaccctgtctcaaaaataaataaaatgaaaaaattgcttttaaatcatgaaaccattctgttttctttacttggaatgttttcttccctgcttaaaatctggcttgtctcaaatctgaactcctccataaagtcttccctattggtttcagctactcaggaccttcaaccatcctggctgcttaccacgtaacttcctgagtgatataccacacccctttattatttcagatattgtgtctcttagggactgttttctgaattacctattgtcccagacatgaagttgctccttgacaaatagttccccaaatggctgtaccttcttctccagaaccctt

SEQ ID NO: 350683 - DNA, 1224 bp, Homo sapiens
  misc_feature (1001)..(1001): n is a, c, g, or t
ggcgcggtgcatgccgggacggcgggggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtcgtctcggagcttaggaatttggaaggtggattccagatggcccgggatcctggccgtagcgccagcgccagagccgcagatggcacggcgttgccgcgggcgccagttgtcattctcctggcatctgggtccccccaaaggtccagctactggctcatggcttggncagttagcccagttgagtgcgaacaagcgcgcgtgccacgattctgtcgcgcgtcgtgacaacacgacaggctaatcacgcccccagccaaggaccttgtggccacacgtaaggggtaggaagcccctatgttgcgccccaaacgccaaacgtggtggggggccaacgcgacaacaggcaaccggggcctcggggaccttggcccagagggtgcccaatttgg

SEQ ID NO: 350684 - DNA, 498 bp, Homo sapiens
tttcgcatatgtggccgtgtgtgctccctgagacagccccaggaggtgtgggcgtgatccgagtttgtggctcaggatctgcacaggcccgagagaccctccttgaggacgcagtggccagtgggggccaccatgtcagggttgaaagtggggctgtctcagatcctcccactgtggcgtttccttcagaaccgagttggggcaggaggggacggagggagagaggcaggaggctgaagcgccgaacccaacgcaaatactaagcatttgatggggttgtctgtgttctaagttggaaaatacaaacttttccatgtgtaccttagataacctcactggcgtttgtcattctgcttttggaatgcttaggcgtgaaagcagcacagcgtcacggtggtgatgcttgcgtagcagtgtgagagtgcaaacctgaaaatgggaaaaaatggggcattttatgttacgtacattttaccacagtgaacataaacagttttg

SEQ ID NO: 350685 - DNA, 4768 bp, Homo sapiens
cgcggccgcgggggctgccagggtatttcgggaagggggcgtgaggaggcggcggcggcagcggcgggtagggcaggcagcagagggaaggagaaagaaaggaaggaagagggcggggagtcctcagaggaggaggcgggaccggccgggcacctcacctctcggcggcggcggcggcggcggcggcggcgggcggccggggaggcggcgccgccccctgcccgcaggtcttctcagcgcagtcggccgcggacccgctggtcccgggcagcggccaaggctactggggcgggagcagtgggccggtcggcggcggcagcggcagcggcggaggaggaggaggctggagtgggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggtattcggaggaagagtcttaaaggatctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaaaaaaaaaaa

SEQ ID NO: 350686 - DNA, 1990 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggttttttttccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcagcagtacttctggaatagaaattctaaacattagcctgccgaacaactggattgcatttgatgattacaattgtccagtcacagatggcatcacctctactttttattattaatattagttttaattgccaaatcataattgtatatatttgtagagtacaatgtaatattttggtatatgtatacaatgtgggatgattaaatcaagctaatatatccatc

SEQ ID NO: 350687 - DNA, 689 bp, Homo sapiens
agcggacgtatctctcctgctccagtgttccttccactaacccatgactgtgtcttcacaacgttagacctctcttcagctgcattgctggctgcctagagccctagactaatgtaagagctagagttaatgccaaagacagcaaatggttgacacctttacacagagcagttgcatcttgtagtgagtctaaaaattacaaggcagatgactaaacagaaacacaaccaagaaccctcagagtccgcttcactcccctgctacctccactggagcaggtgctagtatccacagctgaaggacctgaagacagatcacatcacaggactctttacagacattccccagtaccatcccggagcctagtagctccactgggttactagactcagaagagcaaaaacaatcactacagtttggctctcaggaatacccattcctaggggaagtgggagaacaccacatcaagggaacacccagtgggacaaaataatttaaacagtagtccttgaatcccagatcttccctctgacatagcctacccaaatgagaaagaaccagaaaaacaattctggtaatatgacaaaacaaggttatttaacacccccaaaatataccagctcaccagcaatggatgcaaaccaagatgaagtctatgaattgccaggaaaagaagtcagaagattgat

SEQ ID NO: 350688 - DNA, 312 bp, Homo sapiens
  misc_feature (49)..(49): n is a, c, g, or t
gcctgcacaggtgtgaactgttaagaaggttcccccaccttttcagagnagcaaaaaaaaaaaaaaaaaacctataagcaagttgtttcctaaagcctcctcagaatctcttttgcaaatgtgatcttccttttaaacaatgacaacatgaatcgtgtgttatttcctcagtgtgccaatatgtaagtatataactttctaaattctagataagatgaatttcaatgttttattcttcatagaatgtaaatcatcatttttgtcacatttatcttcatataaaaacatgctttcatgcttctttaaacctac

SEQ ID NO: 350689 - DNA, 3211 bp, Homo sapiens
tgccattgtgaggagggatcaactgggaaaggggcatgaagggacgttatgtgatgatgagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggaaaaaggcactttgatattcacgtagaaattcaacctaagaggaaagatcccacagtgagccaatgttaagagatctgatggtattcggaggaagagtcttaaaggatctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaaaaaaaaaaa

SEQ ID NO: 350690 - DNA, 2508 bp, Homo sapiens
  misc_feature (34)..(34): n is a, c, g, or t
caatattaaaagagcttttttatttgttaatgtnacataagaaatttaagcaagtacattatcttaaaaaacacaacgaatgcattttaatagagaaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggaaaaaggcactttgatattcacgtagaaattcaacctaagaggaaagatcccacagtgagccaatgttaagagatctgatggtattcggaggaagagtcttaaaggatctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaaaaaaaaaaa

SEQ ID NO: 350691 - DNA, 2211 bp, Homo sapiens
ttcgcctgctgaggagaatgttttcatgttacttatactaacattagttcttctataggttgatagattggtccaattgggtgtgaggagttcagttatatgtttgggatttttgacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggaaaaaggcactttgatattcacgtagaaattcaacctaagaggaaagatcccacagtgagccaatgttaagagatctgatggtattcggaggaagagtcttaaaggatctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaaaaaaaaaaa

SEQ ID NO: 350692 - DNA, 2881 bp, Homo sapiens
  misc_feature (2780)..(2780): n is a, c, g, or t
  misc_feature (2834)..(2834): n is a, c, g, or t
  misc_feature (2847)..(2847): n is a, c, g, or t
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttgttttttttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaaagcnttgggcaatacatgggaaatgttcccccctccaattttgggaaaccctttaagncgggtttttcaanaattgccggcaaaaaaaactttctttccttcaag

SEQ ID NO: 350693 - DNA, 2008 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttgttttttttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcagcagtacttctggaatagaaattctaaacattagcctgccgaacaactggattgcatttgatgattacaattgtccagtcacagatggcatcacctctactttttattattaatattagttttaattgccaaatcataattgtatatatttgtagagtacaatgtaatattttggtatatgtatacaatgtgggatgattaaatcaagctaatatatccatc

SEQ ID NO: 350694 - DNA, 1993 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttgttttttttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcagcagtacttctggaatagaaattctaaacattagcctgccgaacaactggattgcatttgatgattacaattgtccagtcacagatggcatcacctctactttttattattaatattagttttaattgccaaaccaatcgtctataaagagcagaacagccaattcgggacaggctaccggtggctcttaacagctatttccccaaa

SEQ ID NO: 350695 - DNA, 2635 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttgttttttttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaaggtaaggaacaaaatcagaatctataagtatttcatatgtcactgttaaaacaa

SEQ ID NO: 350696 - DNA, 989 bp, Homo sapiens
  misc_feature (900)..(900): n is a, c, g, or t
  misc_feature (904)..(904): n is a, c, g, or t
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggttttttttggaaaggatntggnccctttccaaaaacttgaaaaaatggtaaccctttgagtatacatttcaacagatttggcgcgaagccaaaatttttcgggaatg

SEQ ID NO: 350697 - DNA, 482 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaaatccctacattctccaccttctggaaatgtatggtaagaccatcactggtgcaagctatatttaacggagatcctgatgaagttcgagcactaatatttaagaaagaagatgttaactttcagcagtacttctggaatagaaattctaaacattagcctgccgaacaactggattgcatttgatgattacaattgtccagtcacagatggcatcacctctactttttattattaatattagttttaattgccaaatcataattgtatatatttgtagagtacaatgtaatattttggtatatgtatacaatgtgggatgattaaatcaagctaatatatccatc

SEQ ID NO: 350698 - DNA, 350 bp, Homo sapiens
atttctgagcagaatatgaaggttatttgaaagtcactcaaaggactgggactgggattgctgctactgcctggaggcgatgaaataactgcattttcatcttatttcatatacttaaaggttctctgccaccttgctttcttcttctagctttatgtccagtcctccgcaagacttagtatatggtagtctaagtctcactgtaaataaagtatttgtaactgggaggagtaagagtcaactatgcttttgtttactagttatgtctctggcttttatctttcttgtattaacttggacccaaaagatctccactgcactacgctgctgccaactgcaattaccagtgc

SEQ ID NO: 350699 - DNA, 715 bp, Homo sapiens
tatctcccccatatatttagggaattccaaaaggcacatttatttcacaacccctcctaacaagggagactccacttctgcagaggacgtttttatttctgctgtggtctgattctggaatagaataccaccattcacccaaatttaccaaaccagaaggaaagtcaaggaaaagatattcatgtgtgtaacagatactttaggttaaagatgctcttatttagacttaccttataaattacattaaactttgcttcccttcaaggggaaataaaattcaacgagcgtagatataaaacaagaaaagggaggttgacaatttaatatagcacttagagccctgctacaaaaataactattttcctacgttatggatattcacaccaaaattttagacctatgtatatagatttgacgtctgttgtgatataaaattgtttattcaaaacacctaattttttggagccaaaggaagcacgggtttagggtaaaagttagcaaagctctatataagttgagacttaatatagatgaatacttcccaagctaaatatttttgttttgacttttatttcagattgcaagtgaaactcctctagatgttgtaagtattagtcaattccctcccaccaattagtattggtcagttccctcctaccagttatgtttatctgtttgctctcattagagctgaaagtgtttttacatattaggc

SEQ ID NO: 350700 - DNA, 457 bp, Homo sapiens
aagcctcctcagaatctcttttgcaaatgtgatcttccttttaaacaatgacaacatgaatcgtgtgttatttcctcagtgtgccaatatgtaagtatataactttctaaattctagataagatgaatttcaatgttttattcttcatagaatgtaaatcatcatttttgtcacatttatcttcatataaaaacatgctttcatgcttctttaaacctaccaatttcattataaaatcactgtcaattaagttttctaactgtattttctctcaataggaatttggagtgcctaaaccttctgctgaatactggtgcagactttaataaaaaggacaaatttgggaggtagggtatgatacagtttctttatggagcctatttttacttaataacttgattgaccttctaactggcttctgaaaattaactgaacaatttagcatcttgtacactga

SEQ ID NO: 350701 - DNA, 459 bp, Homo sapiens
tctttgggagtctctccatgtactactttctcctctgttgctctgtcctgagaattccagcccctttgttcgctgcagactgtctcctaaactcacagggaattaaaaacaacaacaacaaaactttgtatacagcattaagaattttattgattgaagcagctgacattccactgaatgttttcagacttagacattacatattttgtgaaatggtaattttcttttatattccagcagtacttctggaatagaaattctaaacattagcctgccgaacaactggattgcatttgatgattacaattgtccagtcacagatggcatcacctctactttttattattaatattagttttaattgccaaatcataattgtatatatttgtagagtacaatgtaatattttggtatatgtatacaatgtgggatgattaaatcaagctaatatatccatca

SEQ ID NO: 350702 - DNA, 273 bp, Homo sapiens
gtcagtctaaatatgtatgttttaaatttacatttttatttatttctaggcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcaggtatgccagatattatgcttga

SEQ ID NO: 350703 - DNA, 5734 bp, Homo sapiens
tatagaattttttagtttgatttggattagtcacagaactggcatgaaccttctaattgtgaaggctgtccaaatgcactatttttttctcctgctagaggaagttacatcccgagaagtagctcagatctctggtaagtgtaacatgtgagcattactaggcatttcatcctgtgggtctgcagtctttgctcttcagactgttgctccgttggaatgcttctgtgggactgatactgaggttctatagatattttttaaggacctactcatttggggatgtcagtggtgttttgcaagatcatctgaggaacaggaaagcatttgaaatctgaaaaggataactgtggcggttttcacagtggaaggaaactatattggcaaagaggcagatgactgaataaagtagttggctcaaagaagatgcacagtctgctatttttttctctgaatgaagactgtttaatggaagctgtattcatgtggagatcaaaggaaacactggaatgatacactactatgtttttcccccccctttttttttttaaagaaaacaaaaagcctgaagcagtaatttgagctcaaatgccttctaattccttcacagcctgcttgttctactaggattctccactaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttgttttttttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtatggtaagaccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggaaaaaggcactttgatattcacgtagaaattcaacctaagaggaaagatcccacagtgagccaatgttaagagatctgatggtattcggaggaagagtcttaaaggatctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaaaaaaaaaaa

SEQ ID NO: 350704 - DNA, 484 bp, Homo sapiens
gctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaag

SEQ ID NO: 350705 - DNA, 393 bp, Homo sapiens
ccatgttggccaggctggtctcaatctcctggtctcaagtgatctgcccacttcagcctcccaaaattctgggactgcaggtatgagccaccatgcccagcctaaagaggtatttaaaaagtcatttttgataagaaaatgtggaacattattttggtcttttaggtgtcttgaacatagtctacctaatcatctagacaggaagataattaacctctattttaacaaacatttttcttcttgaaatgaaatattcttttagataccaaaatgaattaaaattgagtgattactattaaagctgcaaaattatttgggagactgagatagaaggatcacttgagctcaggagttcgagaccagcctgggcaaccgtgaaactttgtctctact

SEQ ID NO: 350706 - DNA, 188 bp, Homo sapiens
tcttcttccctccccaccattccccgcaggggaaagacccccgcaaggagaatgacaggcccacctggggcctaaactccatagctcaaacaaggctgggcactcatttatcagcactagaaacttcgcacatcttttccagtctaagaactacacaatttacaggtggttggtatgtgaatctctct

SEQ ID NO: 350707 - DNA, 3621 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccagggaagtgtcgcttcgggtgtgtcctacggacgtgtgggaggtggcaggcgccagcctccgagcagtgtggtggtttatattcatgtttgtggaaaaatcttgcaagacatttctcctttcacagaactgcccaggtgttaacagggctgtctggacggggctcttttgcttccccctcaatctggggtctagagttgtgcagggaattcagctccagtaaggcctggattgcccggggtgagcgtgtgtgtggtgggaagacctggcttccgcgagagccttgttcctggaggcaggagcgccccgccatcctgggtacccgcgggtccgcaggctgcgcacctctttccctcagccaggtcaccctcagcgtcctccctgcccctctccccttcacacctgctggagcctgtgagggaggtggcgggtccccactgtggcgacggagagctgacagtagcccagggctttccacctgcatggaacaagggcctgtctgccgccagcgctgtggccacagcctgcataggtgacaaggggccgctgcgttgggttttgcccgcatcttctgttccatgggtgcccagccagccaggccgtgtgggatccagcgagaggccagggcttggagtgggcctgggaccaggaaggacctctaggctgtggctggccttgtgcagaccctggactgcatccggttccccaaagccctgctgcattcgagtgtcccccaaccccgggcaggtggcacctggtgacacctccttcagtcccactcagctgggcggccggggcaggcttagggcacagttaggggccaaggagagggaaggccagggcccctgttctaggggttagggttctttccccaaaggaacttaaaaagacaagcgtggccaggcacagtggctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaaaaaaaaagacaagcgtgtctaacgtaaactgccggtggcgagcgtcaggtctgggcagtgtcccctgggcctggtcagtgttcccctgggcctggcctctttacccccagcagggcctgttgggacgagcccctgcagttggaggcctttggaagggaacggggtgcattataacgctttcttgtttttgaagtttctttggtcaaaagctaaggaaacaaccatgctaacagaagtttctggaaaaaagcaaattagagatgccgaattgcagttgtgaaactggaagccacagtgactttgcatcttctttcacatgtgtgttcacagggaggggtttttcatggctgcgccggcactgtcacgctctggctgtttccaggccctgctgggtgcacgtttccccatattcagaattgttttaaataaccgcattgtgcttatgacatgaatgactgaattcctctcctattggtagcctcttttacttttttatttttttatttttgagactgagttttgagttgagttttttttgagaccgagttgttttatttccgcacatgaatggtagttccagctactcaggaggccaaggtgggagaagcgcctgagcccaggagagaaccatcgagagg

SEQ ID NO: 350708 - DNA, 1674 bp, Homo sapiens
ggaggcagtggagaggaacaccaggcagggcgtctcgtctcagccaagcctttctctctgctagcaatcttgaggacagagggaaggcctgtctgaatgtttacacgtgctgcattttgtagctgacatgcacactcaggccatacgttctggtggtggtgctggtcacataactccctaactgcaagactgccttgcgctggaggagacctaggatcgttgatatcatctgcgtggactttaaggctggcatgtttgcagacagtggcgcctgcccgcacttaggttcccatcagagcgtgtaaccatgggagagtggggggcacggctgtcttggggctcatcgaggctgcctgtcatgtttgctttttctttcctcagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350709 - DNA, 1369 bp, Homo sapiens
ctctccacgtcttccttccccttcttccctccacttcttccctccacttctgtccttgatttctggggctgccttccgtgttgggcctctggccacacgagtgtggttggcatgtgatgccctcaccaggggcaaccctgggtccgcggcagaccactcagggcctggagctgcctacctgcagtggagggggttgagcacagtgccgggcagggcagggggcccatggcaagaatggggtgcagaggaggcacatggtggacctcctaccccacgctgggaagccttccctgttactctctccatgctaaactggccccagggcctagggattcaccccttcccttgcccagagctccgtgccattgaagccgtccatctcatttcccatgaggcagtggcctcctctttgtagccggcccttggctgtgtgaaccctgtcggccctggcgttcaggacctggcactgcctggcgtcctgttcttccacctccccttctgccttgagcccagtcctgcctactcctctgtgcctttgctcctgggtctcatgaccctgtcctcacgctggtccttctgaggtcagcccttgctgaggtcctgagccgtgtggatggagcttggcgcccacactggacacgggatgcgtctggctggctgttgtggccgtgttgtcctcccaggtctgtggtgctggcatcctcagcctgagttggagtaagtggaaagagcccgtgttggcattctctggctcatggggtcttgctgttttgtcagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350710 - DNA, 300 bp, Homo sapiens
agaaagagggctggtgctggggagagggctgggctggggaagagggtaaagtgcgtggagacgcgctgtcccagaagaggtctgagaagccgcccgcaggtgggggtcacactgcgcctggcttctcctcggggcctgtcctgggctgagccagtgcgatctcctgctgggttgctcctgccacctcctacctggtccccttgtctctgcccctctccacagtccatcctcagcatagaagccagagtgacttctgtgggcaccaagcacacgtcgtttcccctctcccccagcctctga

SEQ ID NO: 350711 - DNA, 1412 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgacccctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350712 - DNA, 1534 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagaggtaggactagggggtgtgttagtcatggagccggcgtcctcacctgcttgcttctcccctggatgggggtcacctgcagtgtctccccctgaagcatgagtgccgagtcccccatcctgggtgcctgctatccacgcatcccggaaatgccctgtcctcggcatccctcctgtaggcctctccctgcctcccccacccaccttccttgtctgcagctcccccgagctgtgtgcgctgccctccctcccggtctggagacatcctcctggctgggctgcctccttccgtgcctccgtcttagatccaagccccgtccgctcctctc

SEQ ID NO: 350713 - DNA, 1734 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350714 - DNA, 1842 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcagattaaccttgtggccactgtccagcttaggaaaccgtcaaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350715 - DNA, 1671 bp, Homo sapiens
gccaggggaggcgggcgcaggaggcgcgtgctcagtgtgctgggtaccaggcgactccgggacagggggtctcggccgtcggcgtcatggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350716 - DNA, 1348 bp, Homo sapiens
  misc_feature (22)..(22): n is a, c, g, or t
gcacgagggaacgacctcctgnagtggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350717 - DNA, 476 bp, Homo sapiens
gaatgcctgagttcactttcttcttttagtatttgagatatattacaggagagtgcagaagccctcagtataatgctggatgaattatcaccaacagattaaccttgtggccactgtccagcttaggaaaccgtcaaggttcgcaattttgaatttccaaaatggagtatggtgcctgataccttgtagatctcagtcggttttactgtgtgcgtgaagtagcagttacctggagtagccgcatagccacaggcgcggcaggttctgggttagaaggattgtttgaaggggagggccagattctgccccccagttgcctttaccgtaagtgggactttggtctcattcaggcagtcacgtttctgtggcttcctttctggcactcgaaggtgtgggattcatttggtccaaccgttgctgttttgatgcaggtggttttacgcacgacgagctgctgaaggtgtggaaaggactgt

SEQ ID NO: 350718 - DNA, 1801 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350719 - DNA, 3649 bp, Homo sapiens
caaaaccctcatttcgagcctaatgggctaatatcttacactttaaaaataaagtgaaaagccaggataatgtcaccaagagattggactgaattccgcctgatggtcctgaggttcctgcagttgatttttctgactcctctgttctctggtgaccggagttgagaagttcttaccctgcctgtctgtaggactcacttgaggagcctctaaaaatcctcatgtccagatcctggtccagcaagatccagttctgggggtagggcctgggcatcagcattttttatctatagctatgtaaagaacgggttcctccatgttctcacctccctccccagagtggcttcgtgctcctcagtggttctcttctggcttattccttctccagagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccagggaagtgtcgcttcgggtgtgtcctacggacgtgtgggaggtggcaggcgccagcctccgagcagtgtggtggtttatattcatgtttgtggaaaaatcttgcaagacatttctcctttcacagaactgcccaggtgttaacagggctgtctggacggggctcttttgcttccccctcaatctggggtctagagttgtgcagggaattcagctccagtaaggcctggattgcccggggtgagcgtgtgtgtggtgggaagacctggcttccgcgagagccttgttcctggaggcaggagcgccccgccatcctgggtacccgcgggtccgcaggctgcgcacctctttccctcagccaggtcaccctcagcgtcctccctgcccctctccccttcacacctgctggagcctgtgagggaggtggcgggtccccactgtggcgacggagagctgacagtagcccagggctttccacctgcatggaacaagggcctgtctgccgccagcgctgtggccacagcctgcataggtgacaaggggccgctgcgttgggttttgcccgcatcttctgttccatgggtgcccagccagccaggccgtgtgggatccagcgagaggccagggcttggagtgggcctgggaccaggaaggacctctaggctgtggctggccttgtgcagaccctggactgcatccggttccccaaagccctgctgcattcgagtgtcccccaaccccgggcaggtggcacctggtgacacctccttcagtcccactcagctgggcggccggggcaggcttagggcacagttaggggccaaggagagggaaggccagggcccctgttctaggggttagggttctttccccaaaggaacttaaaaagacaagcgtggccaggcacagtggctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaaaaaaaaagacaagcgtgtctaacgtaaactgccggtggcgagcgtcaggtctgggcagtgtcccctgggcctggtcagtgttcccctgggcctggcctctttacccccagcagggcctgttgggacgagcccctgcagttggaggcctttggaagggaacggggtgcattataacgctttcttgtttttgaagtttctttggtcaaaagctaaggaaacaaccatgctaacagaagtttctggaaaaaagcaaattagagatgccgaattgcagttgtgaaactggaagccacagtgactttgcatcttctttcacatgtgtgttcacagggaggggtttttcatggctgcgccggcactgtcacgctctggctgtttccaggccctgctgggtgcacgtttccccatattcagaattgttttaaataaccgcattgtgcttatgacatgaatgactgaattcctctcctattggtagcctcttttacttttttatttttttatttttgagactgagttttgagttgagttttttttgagaccgagttgttttatttccgcacatgaatggtagttccagctactcaggaggccaaggtgggagaagcgcctgagcccaggagagaaccatcgagagg

SEQ ID NO: 350720 - DNA, 450 bp, Homo sapiens
ctccgggccggccccgtccccgcggcccacccacctggtcggcgatgtgctgggtctcggcggtggccggctgcgtggcggagggcgccccgcacatcatcttggcggcgacggagggaatctggcgaggggactcggcgaggggacgcggcggctcctcagcccaagtaggcgctggggtcacgtgacgcgcgggcggaaccaaggggcggggaggaggcactttggcttcggagtcccctgcggggtcgcggtggccccgcaagaagggacgcgcggggcggggcgcggggcggggcgcggggcggggagcctggccaccactcgccgcaggctgggtctccgcgcccagcgctggtgtcgggagggagcgcccccctcccggggctggtatcgtctttccgggcgccgagtcacacggaccggggcgggggcgcggccgggtgtcgc

SEQ ID NO: 350721 - DNA, 1592 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagaggtaggactagggggtgtgttagtcatggagccggcgtcctcacctgcttgcttctcccctggatgggggtcacctgcagtgtctccccctgaagcatgagtgccgagtcccccatcctgggtgcctgctatccacgcatcccggaaatgccctgtcctcggcatccctcctgtaggcctctccctgcctcccccacccaccttccttgtctgcagctcccccgagctgtgtgcgctgccctccctcccggtctggagccaccagggtgccggcgggcgggggcagcgcgggtctcagtgcctggccaagcgagacaggcggcacctgggcagggaggcaacctgaggcagtgcgaccctgaagccaggggagggaggtggagc

SEQ ID NO: 350722 - DNA, 1098 bp, Homo sapiens
gccaggggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggtgggggtcacactgcgcctggcttctcctcggggcctgtcctgggctgagccagtgcgatctcctgctgggttgctcctgccacctcctacctggtccccttgtctctgcccctctccacagtccatcctcagcatagaagccagagtgacttctgtgggcaccaagcacacgtcgtttcccctctcccccagcctctga

SEQ ID NO: 350723 - DNA, 1749 bp, Homo sapiens
ctccgggccggccccgtccccgcggcccacccacctggtcggcgatgtgctgggtctcggcggtggccggctgcgtggcggagggcgccccgcacatcatcttggcggcgacggagggaatctggcgaggggactcggcgaggggacgcggcggctcctcagcccaagtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350724 - DNA, 1625 bp, Homo sapiens
gtctctaagatcccccacttctgaccgcggtctatctgttggttttcggaactgaggccatgattaagaagtgcgcctggggcacccaggcgcacttctggatgcaggacatagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggga

SEQ ID NO: 350725 - DNA, 351 bp, Homo sapiens
tttttctgatgtcggcctcggctgtgcttcttctttgggggtgaagagagtggggaggcagtctccacccctgggaggcagaagccaggtgagaaccagagtgggttggggcctcattgcagggctggggttggcccagggagagggcagtgtcccaatcttagagatctgtcctggcttctcagagtggcaggggtgttgggggagcttcctgagggacacctgtggctgcctagatagggctgggggatcccagtgggatggtctctgctccaatcccaccatgttctaggacaacagcaagggttcctggggctttggcctgagagaagtccctgtggtttgacctgg

SEQ ID NO: 350726 - DNA, 964 bp, Homo sapiens
aggatacacctgggattgtgtttgagctcaaggagaatggcacagtgagatgctatgggccgaaacatgaaaaccacagtcaacagggatctcctgaagatttaaggtgctggcactgacctggtttggtttatagaagaaatctccgaaaggtcctcgccagaaagctgtgtctcctactctccaggactcaacataccgggacatcagccccatctggtagcactggaagcaaacacagggagacgtcagcgggacagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacagattccaggaaggctatccttacccctactccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaactgctcgccatgatccacatact

SEQ ID NO: 350727 - DNA, 2024 bp, Homo sapiens
ctcctgcctgacccaggagggccatgcctcctcctacctggtgtgagcctcaggtgggattgctggggtgctctgtgaggagagccctggccctggggacttcccacccgggatctctgcctggaggactccttcagtcccgcccctacctaaggccctgcccagtgctccactccagctcctgcttccctttgcaccctccagccaatccagctcctcgcagctcccagggtgctctgcggcttcattagctctggcctttgtaggtgctgctccttttgtctgggaggcttcttgccttctcccctccccattactgtttgtcaggctatcctccacttgtccttccaggtttagcataagtgtttcttattttgggaaacttctgaccaccaccgtccccatcccaaccctcacttaagtgcctcaggtgggctgccctggcctccgtattcccccatcagagcacgatcacattgctgtgcgtagaacctcttcacatgttttttttcctccaccaaacagaactccaagctcctagatccttgagggcagggtctggggatgcattcatttgtttcatcccacagatacggagttcctcctgcggcaccattgtgctgcaccccactgctcagctgacggggtccaggcctgctctctgtgtagtgggcagtagcagtatctaaataaattcctgatagagcatcaggcagtaatatgcaccctggagagacctacagcagggtcaggactgcgaaagcggagtaggggtactgcctgctctgggaccaaccaggccccacacaggcctgagtgtgggcttgctaaatggagtcgctgagcctttgaacattctcagcaggtccgttcttgaactggttctccagcagctctcagtgctgtttccacctgaaatgcctgctgggtctgtgccctttgctttggccccagacaccctcagttcacctgcatagtcacaccagccacctccgtgctctctgctcttagtcaggttttccctcctgactctgtgtcttcaggttctcttccctcagcctctcccttccaggatactgactcagggctgggcctgttgtggtttggagacagcttctcctcacctctgcagcctcatctcctgccgctccacccctcagcattcgccctgggctccagcccgatcttgcccttcctgccttcatttctacttcttctattgcatgtgctgggctttctgaagtctccttccttttctttttctttctgccccattctgctcacccttccatgtataaatgtcggcaagtcagtcatttcttcctgctttcttctttttcctacttctgcagtggggtctgtctcctttcattttcactatttgaacagctgacggtaagctccttgaggacaggaaccagagtcaagttactgctgtgtctgtttccagcacaggatataggcgcagcagaaagcaagcaggtgcccaataaatgtgtgtggaatgggtgagggatgattgtccctgggattagagagggcagcagcccatttcaaccatcattcctggtggtggaagtgagagggcctcgggagcagagcagcgtcaacagttgttttggctgaagggggctgggaatgcttcctgtcctcccaggctacagcccctcaatgccccttcttagtccgagagagagacgatgtcagaaaaagaaagttactgtccaggcactgaagatttacttcaatccaatctttgttttaattgctgccgttaaacctagtagcaggatcctaatgaaccgtgttctttccaggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350728 - DNA, 955 bp, Homo sapiens
cccacccgaggggagaaagcagggagtggctgtggccctcctggccgatagcgactccccatagaaaacagagggcaccaggaggaacctttttctacttccagaaaaataaaagacattccagcggaccaaaatgtgtttgcaagacaagaaatggaaaatggcttttagacggcccccaaatatttaaagtgagatggataccttccctcccaacccaccttccgccaaggccatcgcgactccacaagaacacagaatttgcaggcccaggaaaagaaggcagacgcctcaaacacaaaacatcttgttatgcaccaggaacaaaaactgtgcccaagaagtcaccttgcattttgtaatcagtgtaataaactccaacccacattccccaaacatgtcaggaagggctgcggaaaaaagatgtccctttaataaaacgttatcaacatatatcgtacacaaactacaatgtatcataattacttttttttcctctcttaattcagaaccagactacaaggtaagaaaaaacacagaaacagctacaatgttcccaataatccgcacaaagtcttttttcaggcagatgatatctcacataatatgatatacatggatcagaaagggagggagtaaaacaaagaccagctacaggggagggaggaaggagaagggcatgtcaatgtacaaagaattcgggtgtcttccagggcaagacacaaaggtttccgtggggtgatgaggtgagtggggccatgagcaccctcccgggaggggacaggctccactgtcgggcttgttggtttttgaaagtaaaaacaggactggagccagcacgtctgtttggttgtcggtgtccccccaccccccacagctgctccaaagtctttccatccagtcccaagcatatacagagcaattctgatcagtatcccatctttgagaaaggacg

SEQ ID NO: 350729 - DNA, 1452 bp, Homo sapiens
accagggccatttgtgttgtgaaggcaactgccaggctgccgaggggccccaggctgaggggtagcacagcacacagcaggcgctcttcccaggctgggccccgtgacctgccttcctccagctaggcaccctgatcccatggctctcgtctgtgcctgactcctgctccaaggagcacaggtatcggatggatatcccatccacccaacctcctttccccagccctgggtcagcaccattgatacaggttagtcgcagcctcagtctcttcatctctccaatggagatgcttttccaatagttcaaaggtgtctgtactcagcaaaagcctaggaaaccttgttccaaggtgaagagggaaggaccagatggaatctcctagatcctcccagctactccccaacacacccatttggactctccccacgagtaacatcacttgtagcgaacacatgctgctcttagtccgtgcacggcactgttctaagcacttcacggtgctaacctcctcacagcctatgaggcagccaacccgccatcccccattttgcagatgagagaactgagaacagaagtatcaactaatttgcccaaggccacacagcaagttgcagcaaacaagatttaaacctgggaatttgctatctggtcccctaagggctttataaacatgggctgagcctgccctttgcttggaccctctgtctcccaacccaccttccgccaaggccatcgcgactccacaagaacacagaatttgcaggcccaggaaaagaaggcagacgcctcaaacacaaaacatcttgttatgcaccaggaacaaaaactgtgcccaagaagtcaccttgcattttgtaatcagtgtaataaactccaacccacattccccaaacatgtcaggaagggctgcggaaaaaagatgtccctttaataaaacgttatcaacatatatcgtacacaaactacaatgtatcataattacttttttttcctctcttaattcagaaccagactacaaggtaagaaaaaacacagaaacagctacaatgttcccaataatccgcacaaagtcttttttcaggcagatgatatctcacataatatgatatacatggatcagaaagggagggagtaaaacaaagaccagctacaggggagggaggaaggagaagggcatgtcaatgtacaaagaattcgggtgtcttccagggcaagacacaaaggtttccgtggggtgatgaggtgagtggggccatgagcaccctcccgggaggggacaggctccactgtcgggcttgttggtttttgaaagtaaaaacaggactggagccagcacgtctgtttggttgtcggtgtccccccaccccccacagctgctccaaagtctttccatccagtcccaagcatatacagagcaattctgatcagtatcccatctttgagaaaggacg

SEQ ID NO: 350730 - DNA, 1016 bp, Homo sapiens
accagggccatttgtgttgtgaaggcaactgccaggctgccgaggggccccaggctgaggggtagcacagcacacagcaggcgctcttcccaggctgggccccgtgacctgccttcctccagctaggcaccctgatcccatggctctcgtctgtgcctgactcctgctccaaggagcacaggtatcggatggatatcccatccacccaacctcctttccccagccctgggtcagcaccattgatacaggttagtcgcagcctcagtctcttcatctctccaatggagatgcttttccaatagttcaaaggtgtctgtactcagcaaaagcctaggaaaccttgttccaaggtgaagagggaaggaccagatggaatctcctagatcctcccagctactccccaacacacccatttggactctccccacgagtaacatcacttgtagcgaacacatgctgctcttagtccgtgcacggcactgttctaagcacttcacggtgctaacctcctcacagcctatgaggcagccaacccgccatcccccattttgcagatgagagaactgagaacagaagtatcaactaatttgcccaaggccacacagcaagttgcagcaaacaagatttaaacctgggaatttgctatctggtcccctaagggctttataaacatgggctgagcctgccctttgcttggaccctctgtctcccacccacccaccacggcatccgctcctgctacaagcctagaatgaggtccccagagctccagggaagtacaaagttctttctagtcgtgcaagtcagcatccatagcagcttacctcaccctagccctcagcatttcttgcctaaatgtcgtctgggaatgcctctctccatatcttgccagccccacctgattcatctcccaggagaccaccagcatacactttccaaaatttaagtagactgcactactctcaaaacccttcaagggctcccagtacaccttggaggtttaggaaaaaaaaaaa

SEQ ID NO: 350731 - DNA, 282 bp, Homo sapiens
agcttgtggacctgtgtgccgaatgggcctcttttctttataaatcacccagtgatccaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350732 - DNA, 1498 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350733 - DNA, 1777 bp, Homo sapiens
  misc_feature (1620)..(1620): n is a, c, g, or t
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgcaaaaacaaacaaaagaaaaaaaaaaaaaaaaaaaaaaacaaggggggggccggcaaaaaaattcccccgggggggcgccacaagtcatcgcgcctcgcacccaggtttgtcggtgaaccaagngggggcgccccatattaggggcgacgcgcagatgtatagacgccacagcggcacagggcggacgggatgtaacacacgggcgcaactgggggaaaccccgggcgcaccggggaactctggggggagagagcccataactccgggggggggcgacctt

SEQ ID NO: 350734 - DNA, 1611 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtgacaggtccttgcttctccaaatcccaaatgtctaccagcttcgtcctcactccctcattcaacgcaggagaggaagtgatgcagcggaacttgagggcctcagccagcctcccgcccagtacaggctccccagccagtgagctggtgaaggagcaggagcacgctgcagggagagtgctgcgccgggtcatgctggatagcgaaaccccacgagaggaacttccagcagcagacttttggaaatgaaatggtgacattcccattgtgaacgtatttctcactgtctcatatatttaaattcctggttgttccattcaaaa

SEQ ID NO: 350735 - DNA, 1340 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacagaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350736 - DNA, 1146 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacagattccaggaaggctatccttacccctactccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaactgctcgccatgatccacatact

SEQ ID NO: 350737 - DNA, 1269 bp, Homo sapiens
  misc_feature (14)..(14): n is a, c, g, or t
  misc_feature (25)..(25): n is a, c, g, or t
gagattgtggtagntctagaggatncctacttttccacagggcactttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350738 - DNA, 1202 bp, Homo sapiens
ctatccaggggaggaggctccgacttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350739 - DNA, 1414 bp, Homo sapiens
  misc_feature (14)..(14): n is a, c, g, or t
  misc_feature (25)..(25): n is a, c, g, or t
gagattgtggtagntctagaggatncctacttttccacagggcactttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgaggcagggatgttcagagaacacaggtgttctaactggtggaatcctggagcaggaaaaccagctacggaatgatctgggatttcaggacatctgcttggtcaggatttgtgtatagacttcctggcaatgagtcagctttgcagagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350740 - DNA, 941 bp, Homo sapiens
aacatggcggggtccaggtggaggtcttgaggctatcagatcgggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacagaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350741 - DNA, 462 bp, Homo sapiens
caggtcagcgggtgtatcggacgaggagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350742 - DNA, 281 bp, Homo sapiens
cgcggccgatctttccgccctgggaccgcggctacaaggacccaaggttctaccgctcgccccctcttcacgagcatccgctgtacaaagaccaggcctgctatatctttcaccaccgttgccgccttctcgagggtgaggccccaggacgggcggcaagggaccgtgttcctctaaccagcaccgaccccgaccctctgtggctttgggcaagacattgaaaccctgtggggcttggttttaaagcaggccctctggctcaccaagaccaagttaataga

SEQ ID NO: 350743 - DNA, 1491 bp, Homo sapiens
caggtcagcgggtgtatcggacgaggagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350744 - DNA, 1580 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgcaaaaaaaaaaaccgggtctttcggggcgggaaggagaaggcctggttggtccgcccttgaagggaaccggccagaggtaaagc

SEQ ID NO: 350745 - DNA, 2142 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtgaaaaataaaagacattccagcggaccaaaatgtgtttgcaagacaagaaatggaaaatggcttttagacggcccccaaatatttaaagtgagatggataccttccctcccaacccaccttccgccaaggccatcgcgactccacaagaacacagaatttgcaggcccaggaaaagaaggcagacgcctcaaacacaaaacatcttgttatgcaccaggaacaaaaactgtgcccaagaagtcaccttgcattttgtaatcagtgtaataaactccaacccacattccccaaacatgtcaggaagggctgcggaaaaaagatgtccctttaataaaacgttatcaacatatatcgtacacaaactacaatgtatcataattacttttttttcctctcttaattcagaaccagactacaaggtaagaaaaaacacagaaacagctacaatgttcccaataatccgcacaaagtcttttttcaggcagatgatatctcacataatatgatatacatggatcagaaagggagggagtaaaacaaagaccagctacaggggagggaggaaggagaagggcatgtcaatgtacaaagaattcgggtgtcttccagggcaagacacaaaggtttccgtggggtgatgaggtgagtggggccatgagcaccctcccgggaggggacaggctccactgtcgggcttgttggtttttgaaagtaaaaacaggactggagccagcacgtctgtttggttgtcggtgtccccccaccccccacagctgctccaaagtctttccatccagtcccaagcatatacagagcaattctgatcagtatcccatctttgagaaaggacg

SEQ ID NO: 350746 - DNA, 1458 bp, Homo sapiens
agggcgtatcggatatcgtcgacccacggcgctcggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350747 - DNA, 1448 bp, Homo sapiens
acttaggctaggtcgaggctgggttctcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350748 - DNA, 1170 bp, Homo sapiens
aacgagctttggcgcccggtctcattcgttcccagcaggccctgcgcgcggcaacatggcggggtccaggtggaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggatgatgcaagtcttggaggcagccgggtggtgcagacgtgggcggatggcggtctcatttctagtgttaacgatacaagacgg

SEQ ID NO: 350749 - DNA, 1450 bp, Homo sapiens
aaaggctaaatcagatcgggtagtgggcattgggcggtcccggggtccacggcaaaggggcggggggccgcaatagacgttgtgcttccccgggcccatgctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350750 - DNA, 1099 bp, Homo sapiens
aacatggcggggtccaggtggaggtcttgaggctatcagatcgggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350751 - DNA, 1244 bp, Homo sapiens
aacatggcggggtccaggtggaggtcttgaggctatcagatcgggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgaggcagggatgttcagagaacacaggtgttctaactggtggaatcctggagcaggaaaaccagctacggaatgatctgggatttcaggacatctgcttggtcaggatttgtgtatagacttcctggcaatgagtcagctttgcagagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350752 - DNA, 909 bp, Homo sapiens
acgcgtgggtcgacccacgcgtgcggagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgca

SEQ ID NO: 350753 - DNA, 917 bp, Homo sapiens
  misc_feature (14)..(14): n is a, c, g, or t
  misc_feature (25)..(25): n is a, c, g, or t
gagattgtggtagntctagaggatncctacttttccacagggcactttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacagattccaggaaggctatccttacccctactccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaactgctcgccatgatccacatact

SEQ ID NO: 350754 - DNA, 493 bp, Homo sapiens
aacgtgagctttggagaggacatatgaaaacatattagctggtcatgctggagaagttggggatcagaacatcaaaatatggcaaggcgtggtaactcatgccggtaatacccgcactttgggaggccgaggcaggtggatcacctgaggtcaggagttcgagaccagcctggccagcatggcaaaaccccatctctactaaaaatacaaaaattagctgggcgtggtggtgcacgcctgtagtcccagctactagggagactgaggcaggagaaatgcttgaacccaggaggcggaggttgcagtgagccgagatctcaccactgcactccagcgtaggcaacagagcaagactctgtcttagaaaaaaaaaagaacatcagaatgtgaaaaaacctgaaatgaatttagaagtttaaaacagtttcttacaacaaaaaataatagcttttaagtcaaaatatgtaatgtaggaaatgtcggaattcagtga

SEQ ID NO: 350755 - DNA, 356 bp, Homo sapiens
tgaattagagctgttccaatgcacatgaagagatttctatgaagtatttattgagagagaaaaggaagaggcagggaaagtatatcttttatgatttttttacaaaaattacatccctgtgagtgtgtatatatacacatagacatgtgtgtgtagtaagaatttagagaaaaatacatatatatgtaaaatatgtaaacgtgctagattgttaacatggaggagggtggggtgatgtggctgtgtaggtgaggggggcagaacagtttaggcatattgctattttatgggcttttatggctggggctggacacttccttttaataatattattattttttttttgagatggactc

SEQ ID NO: 350756 - DNA, 429 bp, Homo sapiens
ctccacctacacccccatttcaggagaccccaagggagtgtatgtagatggtaaagaccacgtgcttccatttgtgcagcactttgacatttgcagggcatttttgaacatgttatctcattaaattttcacaataaccaagcgagacatattatattctacttccagactagaaaatgaaggtccaaaagcttaagggctttgcacaaagcccacagccatgaagtggctgaggtggcttggccactattctagagaaacctgggcccttgattgtgctataagcgtactagcctcagggtcagatctcttcctcaatagagaccaagcattcactcctctgcatcaatgccttctaaggctcaaattctcttaccctcgtgtttcacaagtttttctccaagtaactaagcaaaatcctctgtatta

SEQ ID NO: 350757 - DNA, 339 bp, Homo sapiens
atacacaggttccacttcataaaaggaatgatagaagcttagctaatgcacatttcattacaatggatattttaaagcagtacataaaaatttcccaaaataaaactattagctgatttacatttatgaatttgtacaattattcttctggctaaagctgatttacatttatgaattaagaataatttatgaattattcttctagctgacaataatctagttctttcttcaagcataatatacatacatacatacatttatgtttagatttcatatataggctgggtgcagttgctcacgcctgtaatcccagcactttgggaggaccaggtggatgga

SEQ ID NO: 350758 - DNA, 738 bp, Homo sapiens
cagcaactgcttcaaccgaaaagaaattgctcttcatgtaagcatgccatgttaccaaaagaaagaaaacaaaggagaaaattggttcattcaaaattataatagtaaaactcgacatcagaacacagctctggctgatttcctggaaagtaatttttcttcgatcctgacatgtgatggagagccatccagggacaaactgttcatttcctaactctgtagacagagtttaaatacagtggaattcagataataatgaaaatggtcatgaaacaagtgaccatttatgttgtaactgggtccaataaatgggtcttttcattgactttcacaaaatttgattattataattggctgtcttaaagtgtcacagtatcactaggagacttaaatgtctctcttcatatgtgtgtatttatgtgtgtgtctgtgtgtgtattttttctatacctttgagcagaaagtcttattcgttcaaactgtcggcaatctgtaaaaatgaaaattaagattttcaaaattcagtcagaataaaaagaaatcatgattctatttccttttacctctgaagagttaatgattgatcactaattgtacatttgtttctaaaagtatatgaacaatgcctcaggaatgtaacaaagttatagcttaagagctccactgacaaaaatttacaggatatgttactactttaccttggctcctccgctgcattgtatatgctggcaaagtgct

SEQ ID NO: 350759 - DNA, 772 bp, Homo sapiens
ggggttttgccatgttggccaggctggtcttgagctcctgacgtcaagtgatttgcctgcttccgcgtcccaaaatcctgggattacaggcctgagccaccatgcctggcctgtcctcatttgtttatccatctcattttttgtccttctcaccaaagatatgttgctttgtcttgtggggtttttttcatgtggattcctgaaccccatccagccccttgtcccctccccagccagctcacactcttttgcacagctcctgggactcccgttgacacacagggaacagccacccacaatggactgcactgttctgtttgcacccttaaatttatcgtgcttacagaatgacacttctgcaaactagtcaagtagggggaagtgatttgtggatatgcacccttgttcattctctttgaaaaggtaaccagctctgaattctttctccttttaggaggagtttcacttgtcgcccaggctggagtgtagtggtgcaatcttgactcactgctacctccgcctcccaggttcaagcaattctcctgcaccagcctcccaagtagcttggattacaggcatgcaccaccatgctcacctaattttttttttttagtagagacggggttcctgacctcaagcagtccacccgacttggcctccccaagtactgggattacaggcgtgacccaaccgtgcctggcctgtaatgtggtttttatattccagttagtccagatatgacgcacttgaacgcagtcaagctccacatcgc

SEQ ID NO: 350760 - DNA, 561 bp, Homo sapiens
tgttcaggctgccagcccattggaagcacagcaaatgacttctatttatagagaaggcattcctgggccacacacagcactcttggcctgctgagaagtcggccaagtccctgacagacaccaaggggcaagactgcaagcctcctctgccagagaaggcattgttctgtcgcacacaatggtagagcggccctggcatgatgtcagatgagttgacagtagcagcagctgcctgtacgttccctctcctcgtttacagctgagctctgccaaacccagggagcagtccggagttttaggtttggattttggaaaatgaattgcaccaagaggccaggaccgtcttgcttcagttggcttagtaaggaaatggccacaagccataggtggtaatttagcagtggctgcctgagtcgttaggggaatgtaaccacaaaaggcagtagaacgggcagccagggccattgcagggcacagtcacagtggctggccaggaggtctgatggggaggcctttccttcctgaagacccagcctcccctggaatcctcccatttcccga

SEQ ID NO: 350761 - DNA, 552 bp, Homo sapiens
cttaattaaatcacatatgaaaagcgattggcgattaatgaagttgggtgacaggcatatgtaagcttctataatctttttacttttgtgaatttggaaatttctcacaatttgaaaattaaatttctaaattaaaataaaaaaccatacatatgtatatttgtaaaaataaatacataaaactaagggctccttcggtcatgtccacagccgcctggacgcacacacatgtgggtgtggctgctggggctcaggctgtggccagtgggcctgggagcggggcaaggctggctgctggctgctgcagatgggggagctgacttgagatgtgacgataagggctgtgctgtagggtggggactttgagatgcacagtcctctctttggggtgaggctgggtcttccccatagtgatcccttggggccagcacaatgtcacagtctcctaggagattgttttgtaatagtcttgcttaagagatgaacctgcttcaggaattattgaaaataaactttggattaattgtagtcacttctttgtgctgatacata

SEQ ID NO: 350762 - DNA, 1649 bp, Homo sapiens
cctcccaggctcaactgatcctcctacctcagcctcccaagtagctgagactgcatgctcatgtcaccatgcctggctaatttccggattttttcatagaggcggagtttcaccatcttgcccaggctggtcttgaacttctgagctaaagcaatctacctgccttgacctcccaaaatgctggcattacaggcatgaggcatcacgcctggcttccctctgatgtaattttttaaaattagatttcaaacaaaagtaaagttttgaggacttaccaaatatctgtgtactttcagccttggccagatttcaatattttaccatatttgctttagaattttttttggatatttaaatccctgtatacccttccctccctgcctaggggtagctactatcctgagtttggttttgtttgcctacttattgcacttgtatatatcaataaacaatatattgctgggtacagtggctcacacctgtaatcccagcactttgagaagccgggacaggtggatcacctgaggttaggagttcaagaccagcctggccaacatggcgaaaccttgtctctactaaaaatacaaaaattagcccaacatggtggcgggcgcctgtaatccccactactcgggaggctgaggcaggagaatcgcttcaacctgagaggcagagattgcagtgagccgagatcgtgccactgcactccagcctgggtgacagagtgaagactccgtctccaaaacaaaaaaacaatatacaatagggctaatatgtttttaaacttaatatgaatggtatcatactgtacaattggttttgtagtttgcttttgtcactcaatattatgttgatgagatttattgggctgctatttaaagcagttttcttagcacagaggccctgtttgcttgccaaactgcatgtctgctgggttgcgtctgtctttaaagggtgacttcctctaattaatccactggggtgaggggtaagttgaaccttttttctgttcacaagtgtggatacaagctaaaggtggccctgtgtggttccctcactacaaccatggtatagtagtccattgtagaaatataccacagttctattgatggacctgttgggttattctatatgttttgctgttaaaagtcatacttcactgaacattcttggacttgcatctttgtgcacacctggaatattacataaaagtggagttgccagggtgcatataccaaattgcttaacaggctgggtgtagtggctcacacctgtaatcccagcattttgggaggctgaggcaggcagatcatttgaggtcaggagttggagaccagcctggccaatatggtgaaaccccatctctacttaaaaaaaaaaaaaaaaaagccaggcatgctggtgggtacctgtaatcccaactacttgggaggctgaggcatgcgaatcgcttaaacccaggaaggcagaggttgtaatgagctgagatcaagccactgcaagactttgtctcaaaaacaacaacaaaaaccaaattgctgatcaaagtggttttaccagtttacattttgactagcagtatattagtgttcatgatgttctctgtatatctttgttatcagatttttttgataatctgctgggtttga

SEQ ID NO: 350763 - DNA, 360 bp, Homo sapiens
ctcagacaacataatatagcagaaaagatttatagtgtttttggcttgctcacactaaaggcagcaagaaagggaacaacccagtggcataaatataaaatgataaatgagccaaaaagtatagatgtttagctctgatgtgtaccacaatagtttagaagtaaaatgtactttcttgcttttagcttaggctgacagaatcttctttgacaaagtgacaacattcattcactcagcaaaaattctaagctctacattccaagcattgtgtagaaagaaaaataacctgggattaaaagtcactaaaatcacctacaaagtatatgctctgataaaatcatacttcccttaaccacattc

SEQ ID NO: 350764 - DNA, 202 bp, Homo sapiens
tgcgaaaccccatctctacgaaaaatagaaatattagccgggcatggtgtcaggcacctgtaatcccagcctcccaaagctgcttccacattttcaggtattcgttaccagaaacccgcacttctcagtaccaattttctttgttttcttttttcttttttttttttttatagccagggtcttgctctgtcacccaggctgg

SEQ ID NO: 350765 - DNA, 1165 bp, Homo sapiens
ccactctccagccatttggaaacaaaaacagatgctattgttcttccttagagaacgtggcgcagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgcccttgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctctttggctgcattcagcccctacttacctggggaccccggctggggcacaagagcaccaggggggtagggccaaagggatcaggggaagcctctggcctggagggtatggggcacacttccccaagggcggacccagcaggaggaagcccaggagctgggtcctgccgcccaggagctgggccctgccacccaggccgggctagggacatggcagggcctgggcatcctggcgctggacttgggcgacctgggaggcacagggaggggagag

SEQ ID NO: 350766 - DNA, 2811 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccag

SEQ ID NO: 350767 - DNA, 641 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttggtaacaagtcattaattgatcatgatcgtttttcaaaatcgaagatgccagaaattgcttcttcctaaagctagcttgaaatgcctttctttagatggtctgattaggaaaacaaacaataaaaccattagtttgttcccactcaaca

SEQ ID NO: 350768 - DNA, 4846 bp, Homo sapiens
tgccggaagaggaagccgaggctctgagattccgagtcaaccaccgttcactgggcgccccttgagctctgggcgctggcctcctggcttccacgctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350769 - DNA, 4884 bp, Homo sapiens
taaggagagccttttataaaagctaccaaagggatttataggcactgtgaagtagacctgacctcaatttttttttaatttcatttttaaactgaacacagagaagggagagctgttgcttttcttactaagtttcattgcagctgtgctaaaaagcatttttttcttgccctccccactcccccgctttttttttgaccctctcagagaatcattctgataatagaagatagacccgtgaacagcttcatgtgccttgtttttctaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350770 - DNA, 4888 bp, Homo sapiens
tgccggaagaggaagccgaggctctgagattccgagtcaaccaccgttcactgggcgccccttgagctctgggcgctggcctcctggcttccacgtccgttatcttaattgagtctcgctggggttgggaggccgggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350771 - DNA, 4304 bp, Homo sapiens
aaggctagtacgaggctgggtttgaaatcggccgaggctctcttggaagccatactttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350772 - DNA, 3462 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaaaaaaaaaaacggggggggggcgcatccggcgcccccgaaaaagtctttcttaacaaccatatccgcgttgggcgagaccacggggccccaagcgaggtaacatggaacactggggccaaacgtgcgtgtccctacaagaaacaccggggcaaagaacaaaggggcgggagtctcaccaccaccattaaaaacccccccggggcacccccggagacggatccaggacaaaactcccacacggcgcccccaggagggccactccggggggctctctacacaccagggacgccaacgcagagcccaacatcaaa

SEQ ID NO: 350773 - DNA, 3111 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccag

SEQ ID NO: 350774 - DNA, 3154 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagagatacttagattttagaaaaaaaaaaagggggggttagatactcggagggcaagttagtgaccgtttggaaggcgcatagagggaaagaagaggcgtaaagggaggaagcggttggagaccttttggggagggaacaggtaggagtatttatagtactgtggattgtagaaagtagaatgagtcaattagtttga

SEQ ID NO: 350775 - DNA, 3208 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggaagctttaaatgctaccttttagagatgccccatgtcctttctgctgctttgggaaatgatgagaatccgatgttccttttgcacagtaaggcagttactgtgtttgccagtgttattggacatgctgagtaagacatggggattttctcccacagccagttctttgaccttatgttgtattctcatggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacaggtgagttactctacattttctagttaaatgcagtcatgattagtgattgattactttgaaatctattagctgtggggtaagtccagatttttagagtgtccaccctctgcttaagagaactaaagtaagaggcatatttagtagtgcctgtagttggataaaaattaagattctgttgcagtcaggctgacatacctgcctatcagattacatgactgtgtgtctgtatctgctttcagtttggaagcatggaaaagatg

SEQ ID NO: 350776 - DNA, 1377 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatggtaaggcgtagttcttcagatttacttttctgaacagtattttttgaagtataatttgctgcttgcattttgaaattagattaccacgttgggtgatctttatatttgaaattcaagtctttaaaatttttaaaaaatggagaaaagtacagaggataacttgtatgtaccacatgtataatattcattttaatgttttaatgttcattttcaaacagtgaaacaaaagaacctctgacatgattgttcttttagcttgctaagactgccagaattttcccaaaactgttcttattaaaataaaattttaggctaggcatggtggctcatgcctgtaatcctagcactctgggaggctgaggcaggcagattgtttgagcccagaagttcaagatcaggatgggcaacatggtgacacctcgtttgac

SEQ ID NO: 350777 - DNA, 509 bp, Homo sapiens
ctctgagattccgagtcaaccaccgttcactgggcgccccttgagctctgggcgctggcctcctggcttccacgtccgttatcttaattgagtctcgctggggttgggaggccgggtattgtcagcgcttacagatgaggaaacggaagcccacagaggcgaagggattttccttaagtccgacttggcagatgggcttcggcctcagattttctggtttttcagctggtggtcttttttctctcctgcctcatgctaggtcgattccctccctgctcactgccctctcccattctgttccacccactcgcagcaggacactttcctttcctgccacacctgtcttctcacacacttttcttctaagacttggcattcctcccatctctcttctcaatattctctgctatgcctctcctcttgttcctcattcatagtttttcaaggtctttgccccctctgtgctattgaatctctcaactaggtgtggaccctaaagaatgagatag

SEQ ID NO: 350778 - DNA, 4839 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350779 - DNA, 4320 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350780 - DNA, 4975 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350781 - DNA, 4686 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350782 - DNA, 4693 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtata

SEQ ID NO: 350783 - DNA, 2964 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcagggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccag

SEQ ID NO: 350784 - DNA, 2800 bp, Homo sapiens
agcggatcgcaacgaaccggaagtgctaaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggaagctttaaatgctaccttttagagatgccccatgtcctttctgctgctttgggaaatgatgagaatccgatgttccttttgcacagtaaggcagttactgtgtttgccagtgttattggacatgctgagtaagacatggggattttctcccacagccagttctttgaccttatgttgtattctcatgtaagtttttttgtttttatttttgtttttggctcagtgaagtgagattgcgtgcactggcaggcctagtaatatagacaaggtggtggtggtaggaattaggactttaaagaagtagtatgttcagttcctagaggtagtataatagggaaataagaagacagggcctcaagagcaattccttctgctttactgcactaaaaattaaaaaggagaagtaggccaggtgcagtggctcacgcgtgtaatcccagcacttt

SEQ ID NO: 350785 - DNA, 480 bp, Homo sapiens
tgatctagaggatccctcgacggacgcatcacagtcgcatcatatctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaatgcgtcccgtcgaagttgggtaccg

SEQ ID NO: 350786 - DNA, 250 bp, Homo sapiens
tttgcctaaggggataaggaaaaataatgtgaaagttgcagtccttatcagaagtaattgattagaattcagcaatgaatatgccaaatcgtacttatttcagagtaagtttttcatttttttaggttgtagggagtttttttcctactgagtgttattagattattttaatgttactattgttattaggcaattaaaatgtttttaagcaagctttaaggcattaacctcccccttctgtcgtcttctc

SEQ ID NO: 350787 - DNA, 593 bp, Homo sapiens
gaggtgttctagaggatcccgtctacatagtgtagtctgaactgcatagtgatggccgtagagtcgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgtttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagta

SEQ ID NO: 350788 - DNA, 4111 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350789 - DNA, 4882 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggaagtaagtgctggagctcggctgggggaggggcgcgggcgccatagagacctcgggagccgaggcgtggaggagagcgcggacgcgggcgcgcggtgcatgtcacgtgatcgcgccggcttaccttggtgcccatatttgattagggcacccgggttccgccgtcctgctctccttagtcggatttggggggttaactactgcacggagcccttaccaaggatttagaatggttgccctttctgtgcctccgggacttgtgttcgctgctgggtcttcgaattccgtgcccccaccctcttatttccccccgaacttaagatggccgcaggtgggcccggaacagccctcatggcaaacgtctcagagcgtttttccactctgaaaatcgcggagaccgcgcctgagccacagtccagtttttaaggccttggtgtcaggccgttttgctgacgagaaagcctgctgctggtgacaagatggaactggggctgtgtttgtttcccaggacggtcgcacaaacttagcattttggtttatctaaccgagcgcatccatgttcccaaagatcatgtctgttagcccttttgacagcagattaaattttcctcctgaaaggtcacactgtcccaaagctttcagaaaaagtcaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350790 - DNA, 4235 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350791 - DNA, 3825 bp, Homo sapiens
tttgcctaaggggataaggaaaaataatgtgaaagttgcagtccttatcagaagtaattgattagaattcagcaatgaatatgccaaatcgtacttatttcagatgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350792 - DNA, 4581 bp, Homo sapiens
tttttttttttttttttttagaagagtttgctcttgtcgcccaggctggagtgcaatggcacaagctcggctcactgcaacctccgcctcctgggttcaagtaattctcctgcctcagcctcctgaagtagctgggattacaggtgcccaccaccatgcccaactaatttttttgtatttttagtagagacgggtttcactatgtttggcaaggctgatcttgaaatcctgacctcaaggcaggtggacctcaagtaccacctgcctcggcctcccagagtgctgggattacaggtgtgagccactgtgcccagcccaactatatttcttttactgataattgttctaaatttattaaaacatgactatcaagatgagttttagctgtataaaggatacttatagaagttcattcagcttccttggaatacgtacataaggatataaagtttacatttatgttaacttttaatgatgatgacattgagagttaagatttttaaacatttattttgtgctagagaatactacgcagttttacatacatcatcagttgtaatcctcatgacagccctaagagatgcaggtatgattcctactccactttatagaggaagaaactcaggcttggagaggttaagtgactagccagagttctcacaggtagtgtgtggcagagctgactttcagagccagattgtcagactccaaagctgttgagtctaatcactttgctatttaagttgtgtacatctgttttgttacaatttaataagtagttaggatacctcgttatgaaaaaaatcacattctcaaaaaactttttcagtgagaaagggggcctagtccaaattggaataacagttacttttcctgcaattaaacgtttcctgcagttaacagtttcttttcatacaggttgagactcacaaatttgaaaatctgaaattcaaaaggcttcaaaactttttgagcgctttcgtgatgctcaaaggaaatgctcactggagcattttggatttttcagttgtgtgtttgggatgctcaaccagttttatgcgtgtgtatatatagaatgcaaatattcgaaaatctccaaaaatgtgaaattcaaaacacttttggttccaagcatttcacataagggatactcaactggtagctatgattatagttacagctataaaatcaaggcattgcaaatccaatatttgattatatctagttttaacttatgagtaatgatttttattttcctgtcacagtggcgctgtcattaggactgtgcttccttttatatattctttttgtttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattctttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350793 - DNA, 4166 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcatttta

SEQ ID NO: 350794 - DNA, 4057 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350795 - DNA, 3077 bp, Homo sapiens
tcacaccgggaacacctatggccaaggttacggaattggggtcgggaccccgatttttaaaaatactggaaaaaaaaaaaaaaaaaaaaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350796 - DNA, 2914 bp, Homo sapiens
tcacaccgggaacacctatggccaaggttacggaattggggtcgggaccccgatttttaaaaatactggaaaaaaaaaaaaaaaaaaaaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350797 - DNA, 2531 bp, Homo sapiens
acagtctgtggttaatctacaaataaagggaaattagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350798 - DNA, 2730 bp, Homo sapiens
gagaagcagaaacgccacgccattaatattttttctactgaagaaattgttcaaataaacgaggtgaaaaggaggaggtcttctactcttcctaatatgaagtcttagatgatgttttcatcagtctgtaaaatttatggttcataatttgacccactctaaagttaggtaattgaacatgctcataaaggacataagtttaaactggcctctaaagaatactgttcatatgagaatatcaaggacccttttgcttttgtatatttgaattgccgtttatttcaattgctgtttttaaaaatgatgtgtttttgattttcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350799 - DNA, 3798 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacaccctttgatgcagccaacacgaacggttgtcatgtgtaacacaactttcgatcaccgcgaaaacaccgtcctgggaaagcgtccatgcttgatatcgttgggttcatgaacattaagtttccagtacaggtaaaatcccagaggaatccaaagccctctctttatgggtcctgctccaaccatgacagtctgatgcctgtgcaggattgcttccaatacgacccaatctttgactactcctgggggttcaccttagcaagtttgggaggtattccaggcgcgactttgacccacatttggaacgttggggagataccccaggcccctttggagccggggtcttcccatatatagacatggacacgttcttggactcgctcccgaaagcagggtgccctctgatcttaccgcacagctgcgggggggagaccaccccttcggtggacacacagcgtgattgggtacaacatcacctcgggcatagtagaaatcagattctgtctatacacacaagccataccaccaagacacggacacaaccacaacaacactccaacaacaccacacagaccaagcaacaacgaaccacaatcagcatcacagaaagaaagaccacacacaacacgaccactcgcacacgccaaccagcacacacaacacaacaacagtaaccacaccacgaccaaaccacccaacaaacagcacacaacaccaaacacacacagacgcacagaggtagagcgaggcaggacgcaagcgcacaggaccgagcgacacgaacacagacccaggcgacgcccgaagcgacgcacacacgagaccaacacagagccacaggacagagacgagaaaagcagaggaaggccagccagagaatcgaaagaaccgcagaagaagacaacaaaacacgcagaacccacacgaaacacagacacgaagaggacggcaacaagcacacaagccacaaacgagcgtcagcaggagtagacggcaagaacaacgcacaacagacaggccgcaaccacaggcagcgcaacagcggagtaagaaaaccagacaaacgcaagcaagccaccgacggagaaacagcagaagcagagggacaaagagcagagaagacgacgtacgcccagacacgacacgcggaacgacgtgaaagaggcaggagctaaagcgagacaggcacgagcccgacagacgagagaaaaacgcgaaaaacgacaacgaaacccaaacagac

SEQ ID NO: 350800 - DNA, 854 bp, Homo sapiens
taacctgaaccttctcatagacgttgaacgttctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350801 - DNA, 1517 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaacgtctaatcaggagagcgatccaagatcgtcatcacggacagagaagcctgagac

SEQ ID NO: 350802 - DNA, 987 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagta

SEQ ID NO: 350803 - DNA, 482 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggaccaacgcacactcttgcatttttcctaccaatattgtatatgataagctgtcgtcgatgccattcaacgcaggtgtaggtcgtagcgcccatatctaatata

SEQ ID NO: 350804 - DNA, 724 bp, Homo sapiens
agcaaaatcagtgctcacaagtgatttgctgaaagcaaaaatgttattgcaaggctaaaaagagtacatatatttaaaacgttacgactcagcaggtttacttttcctcaacattttaattttagaagtagagaagagagcccgtgatttagaaaaaaatacagatactgtattttagtaaggtaaaagaacatctatttaaacttttgtgttgctaatgaaaataattaaaaaacccattctaaaaacatctaggtggtttacatttgagcagattttctaaatcaacacttagaatttaagcttcaaattctagcagaataagtggagaaaggacttaaaatcactgtcacaggaattacagacatgttgtaatcgtacgttacggcagcaacaaaatattacgaacagctgtttataatcatctggtttatatgtactgctgcagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatca

SEQ ID NO: 350805 - DNA, 708 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggttggtatctcgctttttttcctcttatttgaatttctgtcctgtctgttattgcctttagctttcctagagattggcaagtagacagtactcttggtgtgtgtgtgaaagtaagaatgaaatttggaggaggtaaacctttttacctaatagtaatattaaaatggttaatttatgacatgtacatttgaggt

SEQ ID NO: 350806 - DNA, 4057 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtggttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350807 - DNA, 3778 bp, Homo sapiens
ttttcctagtagagcaggataaaaggaaagacttaagttcttatttatttctttatacagatctgatagatagattcatttattattattattttttaactgcaagggtaattgtaaaatcatagtgtaaagtttgtgtggtgtttctgctttttgtaatgtttggaacttgcctctgcaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350808 - DNA, 4286 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350809 - DNA, 4773 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggaagtaagtgctggagctcggctgggggaggggcgcgggcgccatagagacctcgggagccgaggcgtggaggagagcgcggacgcgggcgcgcggtgcatgtcacgtgatcgcgccggcttaccttggtgcccatatttgattagggcacccgggttccgccgtcctgctctccttagtcggatttggggggttaactactgcacggagcccttaccaaggatttagaatggttgccctttctgtgcctccgggacttgtgttcgctgctgggtcttcgaattccgtgcccccaccctcttatttccccccgaacttaagatggccgcaggtgggcccggaacagccctcatggcaaacgtctcagagcgtttttccactctgaaaatcgcggagaccgcgcctgagccacagtccagtttttaaggccttggtgtcaggccgttttgctgacgagaaagcctgctgctggtgacaagatggaactggggctgtgtttgtttcccaggacggtcgcacaaacttagcattttggtttatctaaccgagcgcatccatgttcccaaagatcatgtctgttagcccttttgacagcagattaaattttcctcctgaaaggtcacactgtcccaaagctttcagaaaaagtcaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcagaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350810 - DNA, 2550 bp, Homo sapiens
gggacctcactccgatccgctgatcagcagcttctcctagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaacagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagagga

SEQ ID NO: 350811 - DNA, 1568 bp, Homo sapiens
  misc_feature (1533)..(1533): n is a, c, g, or t
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacggacagagaaaagacactngagaaaccgtcgattcgagggatcctctgagtcac

SEQ ID NO: 350812 - DNA, 1634 bp, Homo sapiens
cagccgcgcgagaaccgccgggttgccggggcgacgcttccggctggcgcgcgcagccccgggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggaagtaagtgctggagctcggctgggggaggggcgcgggcgccatagagacctcgggagccgaggcgtggaggagagcgcggacgcgggcgcgcggtgcatgtcacgtgatcgcgccggcttaccttggtgcccatatttgattagggcacccgggttccgccgtcctgctctccttagtcggatttggggggttaactactgcacggagcccttaccaaggatttagaatggttgccctttctgtgcctccgggacttgtgttcgctgctgggtcttcgaattccgtgcccccaccctcttatttccccccgaacttaagatggccgcaggtgggcccggaacagccctcatggcaaacgtctcagagcgtttttccactctgaaaatcgcggagaccgcgcctgagccacagtccagtttttaaggccttggtgtcaggccgttttgctgacgagaaagcctgctgctggtgacaagatggaactggggctgtgtttgtttcccaggacggtcgcacaaacttagcattttggtttatctaaccgagcgcatccatgttcccaaagatcatgtctgttagcccttttgacagcagattaaattttcctcctgaaaggtcacactgtcccaaagctttcagaaaaagtcaacgcacctcttgctttttcctccaaagtatgttatgttaagtttcgtgatccatcaagtgttggcgtggcccagcatctaactaacacggtttttattgacagagctctgatagttgttccttgtgcagaagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagta

SEQ ID NO: 350813 - DNA, 2951 bp, Homo sapiens
aaaagttatgcatactcataaaaattcaaacaatgctgaattgaaaaaggaaaagttagtggctctttatccactttatgtcccactgcccagagatcatcaccatgagcagtttggtgtatgacattccagatacgcacacatatcttcatacatacacacatacaaatatgtatacatataacaaaagactgtaaaatataataatatgatcatggacaacttgccatttggacttactccattctttttttttaattttattttcttggactcaggtcacaaatttattcttttaaaacactgcatagtactctacagaatgggagcactttgatttatttaaccaattccttattggattgtgttcaatgcttcaaatcaaaactttcaaaataaaatttacagggtgtcttggttgtgtttctatgtcaatacatagattgacgttatcttttatctttttttaaacagatgcagtgtacttcataatatgaatggaacacaatttctttaaacatgtgtctatcaaaaatcttccaatttttttttactcttatcagtaatgaacatcgttgcacataatctgtgtacaaaagtacgactgtttctcaaggttaaattcctagaaggaggataactggatcaaagggtatttacatgtaaaattggaaacatgttgccaaatgccccaggaggttaaactggtttattctttcactaagggcatatgttcccaacaccctcaccagttttactctccttttcaagtcttgcctgttggcaaatgaatggtataccattagtgttttgatctgcatttctctgatgatagtgatattgaccatctcttccaacttcttgtctgtttgaatactctcctttccaaatgtgtgagtggaaagagctttggttagcagtgagctctaggctttgttgaacttggagccagaacaatctgagtttcaggccagggtctacagaatgggagcacttcaatttatttaaccaattccttattgaattgtgtccaatgctgcaaataaaaactttaaaaatacaatttacagggtatcttggttgtatttgtatgtcagtttaacaaaatgacttgctcagggtctgcccttgaacaagttgtttctgctctttgaccctctgattctccacctgaaatggaaagtgcctgccccgagggcttaatgtgcgcaaaactcccctaaaggacacattgtggatgcttgaaacgtgacagttaggttttgaggggccaagaggctgggtcaatctgggttccactggtgtgagtgggctgtatctcaatgcagtgagctgcccatcccaggagggattcaagcacaagctgaacaaagacagggctcttacaggagtcccggtgagggtgatttataggggttccaaggactccaatattctgcggccctcggattctcccctctttggtcaagtccctcttcgtagggtccttgagttgggaagataagcatttgcttgagcccaagcagcatctaaatgcccccagggagctgtgaatgaagagctttgcaccatgctgagcgcactgaaggacagaatccagtggcccagcctccaacaatggccccttcacagcaggcctaattcccttccacaaatcctcctttacaattctgccaaacctcggcccgctgagatgcccatggtcacgtgatttggggccttctcattgtaggtttctttctgatgctgtcaccggcgtggctattgtcaccatcttgttcttcttcccgtcccaaaggccctctctcaagtggtggtttgacttcaaaggtaaggtggtcaaggctggggtctcggtgggctcagtgaggactgcggcatggagtgtggtcatcaagggcctggagccccccactgcactaaccacgtggtccttcctgcttctcctttcactgtctgagccattgccttgtctggggactgagggctgccccaggtggtagtccaggacaggggttagcaactacagtcttcagaccaaatccagcctgctatctgtttttgaacagcctgtgagctaagcacagttttcagatttttaaatggttgaaaaaaaaaccaaaagaaaaacattttactacatgtgaaagttacatgaaatctaaatttcagtgtccatgtatcaaattttgctttcccctaaggaatttgtggaaatttattttctttagttatataagtacctacacaatagcctcaattttgcctcttggcccacaaaagcaaaaaatgtttatttttcttgtcctttgcagaaaaatgaccccttggcccaaagcaggagttgcaccttggttgcccagggagccacacatggaaaacacaagctgggtttcaaccgtataggaagtgttggggactgaggaaaaactgcctaaaggcattcagattccatttttaaaaaatcactgagtacctctaaccaaaatgttgtagactgtggccttcagattgccagcttgcgactccctccggtgtccagcagatgtctaccagaaggtgacgccaacacctgaggctgccacctgggtcagttggatgagctcctccggagtcaggaaatagggactataatcaaactattttctattgttgagaaaaatagtgtcactcaggatagccccagccatggaagagtcagggtttgagtgtggggagtatagtgtatgtgtcctgtaggaagatgaggattttgcaagctccataaacagttctttctttcttcttcttcttttttttttaatggggtctcactctgtcacccaggctggggtgcagtagcaccatcacagctcagcgcagtctcgaactcttgggctccagtgaacctcccacctcagactcccaggaagctgggattacaggtgtgagccacctcgcttggctaattt

SEQ ID NO: 350814 - DNA, 4057 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350815 - DNA, 4628 bp, Homo sapiens
aaaagttatgcatactcataaaaattcaaacaatgctgaattgaaaaaggaaaagttagtggctctttatccactttatgtcccactgcccagagatcatcaccatgagcagtttggtgtatgacattccagatacgcacacatatcttcatacatacacacatacaaatatgtatacatataacaaaagactgtaaaatataataatatgatcatggacaacttgccatttggacttactccattctttttttttaattttattttcttggactcaggtcacaaatttattcttttaaaacactgcatagtactctacagaatgggagcactttgatttatttaaccaattccttattggattgtgttcaatgcttcaaatcaaaactttcaaaataaaatttacagggtgtcttggttgtgtttctatgtcaatacatagattgacgttatcttttatctttttttaaacagatgcagtgtacttcataatatgaatggaacacaatttctttaaacatgtgtctatcaaaaatcttccaatttttttttactcttatcagtaatgaacatcgttgcacataatctgtgtacaaaagtacgactgtttctcaaggttaaattcctagaaggaggataactggatcaaagggtatttacatgtaaaattggaaacatgttgccaaatgccccaggaggttaaactggtttattctttcactaagggcatatgttcccaacaccctcaccagttttactctccttttcaagtcttgcctgttggcaaatgaatggtataccattagtgttttgatctgcatttctctgatgatagtgatattgaccatctcttccaacttcttgtctgtttgaatactctcctttccaaatgtgtgagtggaaagagctttggttagcagtgagctctaggctttgttgaacttggagccagaacaatctgagtttcaggccagggtctacagaatgggagcacttcaatttatttaaccaattccttattgaattgtgtccaatgctgcaaataaaaactttaaaaatacaatttacagggtatcttggttgtatttgtatgtcagtttaacaaaatgacttgctcagggtctgcccttgaacaagttgtttctgctctttgaccctctgattctccacctgaaatggaaagtgcctgccccgagggcttaatgtgcgcaaaactcccctaaaggacacattgtggatgcttgaaacgtgacagttaggttttgaggggccaagaggctgggtcaatctgggttccactggtgtgagtgggctgtatctcaatgcagtgagctgcccatcccaggagggattcaagcacaagctgaacaaagacagggctcttacaggagtcccggtgagggtgatttataggggttccaaggactccaatattctgcggccctcggattctcccctctttggtcaagtccctcttcgtagggtccttgagttgggaagataagcatttgcttgagcccaagcagcatctaaatgcccccagggagctgtgaatgaagagctttgcaccatgctgagcgcactgaaggacagaatccagtggcccagcctccaacaatggccccttcacagcaggcctaattcccttccacaaatcctcctttacaattctgccaaacctcggcccgctgagatgcccatggtcacgtgatttggggccttctcattgtaggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350816 - DNA, 4062 bp, Homo sapiens
ttgtttccccatctgccatgattataagttttctgaggcatccccagccatgctgaactggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350817 - DNA, 2515 bp, Homo sapiens
atttgtaaccgttcgtacgagaatcgctgtcctctccttgcggccgccagtgtggtggaattcgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350818 - DNA, 3057 bp, Homo sapiens
gcccccgtcgcgccccctgcgctcccacgtcgcgcacacttgcacgccggccctggccgggtcggggctggaggcgagaacgagcccgacgggtctttcccacgggccgtccgcgcctgcgcgacccgtcctcagctccccaggagcccaggtgaccgctcgtcgctaggctagggatgaatcccctgagacggtgccccgatggtcccttgctaggccgtgtcagtgaatcccgagtggtgctgagagttcagccgcctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350819 - DNA, 3106 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgtatcaacaacaagtcgagctggcgctgccttcccagctggccaagctgctcctaggggaatctccaccctcagagtcgatc

SEQ ID NO: 350820 - DNA, 933 bp, Homo sapiens
ttgtttccccatctgccatgattataagttttctgaggcatccccagccatgctgaactggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtgaatatgatggcacctgggacccaaagacaggagccacatcttgagagatagatggcagatctgcccctgtggctttggatcatttacctcagtgaacacaacaagcattatccatgaaaccataggttttgtgtgctagttctagtttttaaaatatgaattaaattaaatacgtatctgttaaaactta

SEQ ID NO: 350821 - DNA, 2380 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaaggtaaggtggtcaaggctggggtctcggtgggctcagtgaggactgcggcatggagtgtggtcatcaagggcctggagccccccactgcactaaccacgtggtccttcctgcttctcctttcactgtctgagccattgccttgtctggggactgagggctgccccaggtggtagtccaggacaggggttagcaactacagtcttcagaccaaatccagcctgctatctgtttttgaacagcctgtgagctaagcacagttttcagatttttaaatggttgaaaaaaaaaccaaaagaaaaacattttactacatgtgaaagttacatgaaatctaaatttcagtgtccatgtatcaaattttgctttcccctaaggaatttgtggaaatttattttctttagttatataagtacctacacaatagcctcaattttgcctcttggcccacaaaagcaaaaaatgtttatttttcttgtcctttgcagaaaaatgaccccttggcccaaagcaggagttgcaccttggttgcccagggagccacacatggaaaacacaagctgggtttcaaccgtataggaagtgttggggactgaggaaaaactgcctaaaggcattcagattccatttttaaaaaatcactgagtacctctaaccaaaatgttgtagactgtggccttcagattgccagcttgcgactccctccggtgtccagcagatgtctaccagaaggtgacgccaacacctgaggctgccacctgggtcagttggatgagctcctccggagtcaggaaatagggactataatcaaactattttctattgttgagaaaaatagtgtcactcaggatagccccagccatggaagagtcagggtttgagtgtggggagtatagtgtatgtgtcctgtaggaagatgaggattttgcaagctccataaacagttctttctttcttcttcttcttttttttttaatggggtctcactctgtcacccaggctggggtgcagtagcaccatcacagctcagcgcagtctcgaactcttgggctccagtgaacctcccacctcagactcccaggaagctgggattacaggtgtgagccacctcgcttggctaattt

SEQ ID NO: 350822 - DNA, 1824 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaattccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctgg

SEQ ID NO: 350823 - DNA, 1107 bp, Homo sapiens
  misc_feature (934)..(934): n is a, c, g, or t
ttgtttccccatctgccatgattataagttttctgaggcatccccagccatgctgaactggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacaggaatagaacccaatactttcctctctgaggaaaggctgaaacttcaagctccccttgtgataagacttggtcagataactgagtctggtcaatggaatatgagtggaaatgatgtgtgcaacttccgggttctgtccttcctgccgggtggaatgtgaatatgatggcacctgggacccaaagacaggagccacatcttgagagatagatggcagatctgcccctgtggctttggatcatttacctcagtgaacacaacaagcattatccatgaaaccataggttttgtgtgctagttctagtttttaaaatatgaattaaattaaatacgtatctgttaaaacttanactgttagaacacaaaaacgagagtactacagcccacacatgccctgacccagacagaactcaggaactgacagggcggggcgaagcaagagagactgctcacgaagggggccccccagtgtgagcccagcccgaatgtgcacacagaagggcccctgtaataacagcgtcaa

SEQ ID NO: 350824 - DNA, 3456 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctgg

SEQ ID NO: 350825 - DNA, 3523 bp, Homo sapiens
gggagcttacgatgagccaggcactattctaaggatggagatacagcaaggaaaagacagaaagcccagcccttatgggcttacattctagtggcaagaaatggataagtgaatcaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350826 - DNA, 3174 bp, Homo sapiens
atttgtaaccgttcgtacgagaatcgctgtcctctccttgcggccgccagtgtggtggaattcgctcagccagtattgggggcacagccacactcacgggcacagcccctaacctcatcctgcttggccagctcaagaggctggctctggatctccttcctgtacgggggactgagcttcaggggctggaggaagaataaatctgagataagaaccaatgcagaagatagggctcgagctgtaattcgggaagaataccagaacctggggcccatcaagtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaaaaaaacatgt

SEQ ID NO: 350827 - DNA, 2850 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctgggtttctttctgatgctgtcaccggcgtggctattgtcaccatcttgttcttcttcccgtcccaaaggccctctctcaagtggtggtttgacttcaaagctcccaacacagagacagagcccttgctgacctggaagaaggcccaggagacagtgccctggaacatcatccttctcctgggagggggcttcgccatggccaaaggctgtgaggaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccaaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctgg

SEQ ID NO: 350828 - DNA, 1338 bp, Homo sapiens
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagctgtaattcgggaagaataccagaacctggggcccatcaagtttgccgaacaggctgttttcatccttttctgcatgtttgccatcctcctcttcacccgggacccgaagttcatccctggctgggccagcctcttcaatcctggatgcaaaatgggcattataagcatttcaacaatacagaaaatgtgaagatcagctaaatctcagtctctaattctgatatacatctttcctgacttttaaacaatgcctatctgagaactgttctacattgtgatcacgctgttatcggactgcatacatttgtcaagacttgttaa

SEQ ID NO: 350829 - DNA, 1059 bp, Homo sapiens
  misc_feature (1019)..(1019): n is a, c, g, or t
  misc_feature (1026)..(1026): n is a, c, g, or t
gcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaaggaaggccgctgcttgtttgtcatcctgctcatggcggtgtactggtgcacggaggccctgccgctctcagtgacggcgctgctgcccatcgtcctcttccccttcatgggcatcttgccctccaacaaggtctgcccccagtacttcctcgacaccaacttcctcttcctcagtgggctgatcatggccagcgccattgaggagtggaacctgcaccggcgaatcgccctcaagatcctgatgcttgttggagtccagccggccaggctcatcctggggatgatggtgaccacctcgttcttgtccatgtggctgagcaacaccgcctccactgccatgatgcttcccattgccaatgccatcctgaaaagtctctttggccagaaggaggttcgaaaggaccccagccaggagagtgaagagaacacagctgctgtgcggagaaacggcctacacactgtgcccacggagatgcagtttctcgccagcacagaagccaaagaccaccctggggagacagaggttccactggatctgccggctgactccaggaaggaggatgaatatcgtcggaacatctggaagggcttcctcatctccatcccctactcagccagtattgggggcacagccacactcacgggcacagcccctaacctcatcctgcttggccagctcaagagtttctttccgcagtgtgacgtggtgaatttcggctcctggttcattttcgccttccctcttatgctgttgttcctgttggcaggctggctctggatctccttcctgtacgggggactgagcttcaggggctggaggaagaataaatctgagataagaaccaatgcagaagatagggctcgagcanggagagnacagcgattctcgtacgaacggttacgattcga

SEQ ID NO: 350830 - DNA, 313 bp, Homo sapiens
aaaacaaaaaaggatgtgtgtaggctggttaatttcgaagatgaaaaccttttcctccctgccacatcttaaattagctcaagtatactacttaaagagaaaggaaaaataagtgtatcaatgactaattctctcaaattgactggaatctatgtctttttggtctgtgtgcacagacaggatgtgatcttctgggatatcacccttctttgaatcagagatacgctgtcatttaaaaaaaaaacctgacaccatccttttagtgtttaacttttaaaaattattccgaaagaaatgtttttaaaagataaat

SEQ ID NO: 350831 - DNA, 366 bp, Homo sapiens
gaaatggcacaagaggagggaaaatccccagatattgaaactagaaagagcactgaaaaccagagccagaagcttgagctacctctgtaggagatgtgagaacagttgtcaaacctcaaagtaagcactagaggtggattttatacccatagaggagctaaagaatgaagttttgtgtgtgctcaagatggtatgtttgaacttaacatcactgcactaagccatgtcctttaaaggaccccatgattagcaaaccccaggcttctatcatatgtgggtttggagcccaaatgtaactatccacattgctcaggagtccccagtgagaaaatggcaccactaaagatgagctcacagtgagatagt

SEQ ID NO: 350832 - DNA, 428 bp, Homo sapiens
tttttttgtttattttgagacggagtctcactctgtcacccaggctggagtgcagtgtggcatgatcttggctcaccacaacctctgcctcctgggttcaggcaattctcctgcctcagcctctcaagtagctaggactacaggcgcctgccaccacgcctggctaatttttgtatttttagtagagatggggtttcaccatattggtcaggctgatctcaaactctgacctcaggcaatccacctgcctcggcctcccaaagtgctaggattacaggtgcgagccactgtgcacggcgctctgtgcatttcaaaaaatcaggagaaccccacatatattcctccttacaagcttgaaatctgagaagaatgtgacctttgcaatctcatttatccatcttttctgatggctgaccgcctgcttattc

SEQ ID NO: 350833 - DNA, 330 bp, Homo sapiens
aaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggt

SEQ ID NO: 350834 - DNA, 419 bp, Homo sapiens
atggctgaagctggaaaaggagctgcagggatgcaggcagtagtgtcctgaggctgcacacagcagtggagccatggggctgagccaggaaactattcttttctcctaaaccccagggccagtgacagcaaggactgctacaaaggtctctgaaatgccttcaaggcctttttcccattgtcttgaattattagcattgggctcctttttatgcaaatatcctaagccttcttgattttccccctgaaaatcagcttttctttttgaccacttgtccagattacaaattttccaaatgttgaagctctgtttctcatttaaatataagttccaacttatggtcatttctttcaccacacataggagcacaggctgttcgatgtaggcagtacaactcttgaactttgctgcttagaagt

SEQ ID NO: 350835 - DNA, 550 bp, Homo sapiens
gcatcactgcaagctctgcctcccaggtccacgccattctcctgcctcagcctcctgagtagctgggactatgggcacccgccaccacgcccagctagtgttttgtatttttagcagagacggggcttcaccgtgttagccaggatgatctcgatctcctgacctcgtgatctgccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatgg

SEQ ID NO: 350836 - DNA, 554 bp, Homo sapiens
gcatcactgcaagctctgcctcccaggtccacgccattctcctgcctcagcctcctgagtagctgggactatgggcacccgccaccacgcccagctagtgttttgtatttttagcagagacggggcttcaccgtgttagccaggatgatctcgatctcctgacctcgtgatctgccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtctgtaatcccagctactcgagaggcaggagaattgcttgaaccctggtggcggaggttgcagtgagctgagatcatgccactg

SEQ ID NO: 350837 - DNA, 440 bp, Homo sapiens
tttttttgagatggagtctcgctctgtcgcccaggctggagtgcagtggcgcaatctcggctcactgccagctctgtctcccaggttcacaccattctcctgtctcagcctccagagtagctgggactacaggcgtccgccaccacgcccggctaattttttgtatttttagtggagacggggtttaactgtgttagcaaggattgtctcgatctccttatctcgtgatctgccggcctcggtctcccaaagtgctgggattacaggcgtgacgagtgtacccagaccctaacttttcaaattttacaatggagagaaaagggaactattttaccaaattcaggtagctaaaattgatagaactatctttcctatggagaatgccctacaaagatacaacactatagcttactgttattacttgctccacaagcaatgtt

SEQ ID NO: 350838 - DNA, 14186 bp, Homo sapiens
  misc_feature (17)..(17): n is a, c, g, or t
  misc_feature (7555)..(7555): n is a, c, g, or t
  misc_feature (10881)..(10881): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350839 - DNA, 14178 bp, Homo sapiens
  misc_feature (17)..(17): n is a, c, g, or t
  misc_feature (7547)..(7547): n is a, c, g, or t
  misc_feature (10873)..(10873): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350840 - DNA, 14092 bp, Homo sapiens
  misc_feature (17)..(17): n is a, c, g, or t
  misc_feature (7555)..(7555): n is a, c, g, or t
  misc_feature (10881)..(10881): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaaagggatggatcgctacagaaagaagatggttcttttgctggagatatttggcgaaagggatgatcggg

SEQ ID NO: 350841 - DNA, 12495 bp, Homo sapiens
  misc_feature (5864)..(5864): n is a, c, g, or t
  misc_feature (9190)..(9190): n is a, c, g, or t
aggacatctcacagcctggtacttttccagcagtttctgcttctagtcagatgcccaacagcgatgcactattgcagcaggctacacagtttcagacaagagaaactcagtctagagagatattacagtcagatggtacagtggttaatttgtcacaactgactgaggcatcacaacaacagcagcagtcaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcctggagatttttaagctgtatcctataatatactcttggtcaggttgggtagtatgattcaaggcacttggaaccgtcttggggaatatagcttggtaattgaactgcttaagcttattattaatatttaagctatagttccaggcccattccagaggtcccccagccaatgcacttcataaaagggaagatatatcttaatataccaggtttgtatctcatgctaccattgtagcatcaaaaaaatagacatttaaatcatggctaataacaaattttagaatgaaatagttggtaaattttgtgattttaaacttttctttttgtgtgtgtgtatatgcagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350842 - DNA, 12608 bp, Homo sapiens
  misc_feature (5977)..(5977): n is a, c, g, or t
  misc_feature (9303)..(9303): n is a, c, g, or t
cagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggccaggctggtctcgaactgctggcctcaagtgagccacctgcctcggcctcccaaagtgctgggattgcaggcatgagccaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcctggagatttttaagctgtatcctataatatactcttggtcaggttgggtagtatgattcaaggcacttggaaccgtcttggggaatatagcttggtaattgaactgcttaagcttattattaatatttaagctatagttccaggcccattccagaggtcccccagccaatgcacttcataaaagggaagatatatcttaatataccaggtttgtatctcatgctaccattgtagcatcaaaaaaatagacatttaaatcatggctaataacaaattttagaatgaaatagttggtaaattttgtgattttaaacttttctttttgtgtgtgtgtatatgcagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350843 - DNA, 11726 bp, Homo sapiens
  misc_feature (5095)..(5095): n is a, c, g, or t
  misc_feature (8421)..(8421): n is a, c, g, or t
ctgagtttagtatgttaaaagaagggaccgaggtcagtgtggctacagtgtagtgagctagaagagcaggaatgagatgaagttgacagggcagggatcttgaccttgtaagccattataaaacacttggattttaccttaaaagcagtgttaagattaatatcctgatgcctgtgaacctgagctttaaaatgcattcttttttttttaatcactttttaaactttacagctaacaggaaatatacttcatttaaaatttttaaatttaagtattgcttcttttccaactcttgtgcttttctttacattagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350844 - DNA, 13837 bp, Homo sapiens
  misc_feature (17)..(17): n is a, c, g, or t
  misc_feature (7206)..(7206): n is a, c, g, or t
  misc_feature (10532)..(10532): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcaaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350845 - DNA, 12031 bp, Homo sapiens
  misc_feature (17)..(17): n is a, c, g, or t
  misc_feature (5400)..(5400): n is a, c, g, or t
  misc_feature (8726)..(8726): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctgaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350846 - DNA, 10319 bp, Homo sapiens
  misc_feature (17)..(17): n is a, c, g, or t
  misc_feature (3688)..(3688): n is a, c, g, or t
  misc_feature (7014)..(7014): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtggggaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350847 - DNA, 4913 bp, Homo sapiens
  misc_feature (3)..(3): n is a, c, g, or t
  misc_feature (14)..(14): n is a, c, g, or t
  misc_feature (1608)..(1608): n is a, c, g, or t
ggncacaaggactncagtgcaggagttttttactggacacagaagtctgattccaagcccactcttcaacagctgagattttgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350848 - DNA, 3653 bp, Homo sapiens
  misc_feature (348)..(348): n is a, c, g, or t
cttttgaaagggagtgagagagggaaaaattgtattatacaggccggacatggtggctcacacctgcaatcccagcacttcgggaggctgaggagggaggatcacctgaggtcaggagtttgagaccagcctggccaatatggtgaaaccctgtctctcctaaaaatacaataattagctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350849 - DNA, 3377 bp, Homo sapiens
  misc_feature (72)..(72): n is a, c, g, or t
tcactttattgcttggattttctttggtgttggttaaggttgtggcctgctttttgctttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350850 - DNA, 5408 bp, Homo sapiens
  misc_feature (2)..(2): n is a, c, g, or t
  misc_feature (4)..(4): n is a, c, g, or t
  misc_feature (6)..(7): n is a, c, g, or t
  misc_feature (14)..(14): n is a, c, g, or t
  misc_feature (16)..(16): n is a, c, g, or t
  misc_feature (18)..(18): n is a, c, g, or t
cncncnntcccctncncncagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctctactaaaatacaaaattagtcaggcatgatggcaggcgcctgtcatcccagctactagggaggctgaggcaggagaattgctggaacctgggaggcagaggttgcagtgagccgagatcacaccactgcactccagcctgggtaacagagcaagactgcttccaaaaaaaattttttttaattaaaaaaaaagtagatgactgcagcaaagaagagatttattagctcttcctttcaaggtatctgtgtactgtatataaacaacaaagctgaccaagagtggtacttgtgctaggcatattagtaactgctttgtaattgaaagcaagaaatatcataaacaagcattagatggctaactaccaaacaagttaagtcccttagggcaggtagattcagtcttttccttctctgagcaattcccttctgccataaactacagagaggtgattaatagaacattggagagttgaatgatacctagccaaactgtaccct

SEQ ID NO: 350851 - DNA, 1306 bp, Homo sapiens
agttccgggccgcgctgcgagactacgagacggtggtcaaggccaagccccagctgcggagctgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350852 - DNA, 3559 bp, Homo sapiens
  misc_feature (17)..(17): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaaggtaccaagtaaattcttctcaaaaatcgtaattgggtgctcctgtatgttttctctagcacaccttactattttgttttctcttaggtacttataatactttgcagggtatcttcatattgtaaaataaatatgtgtttaactttactaaatgtagagacttgttttccaatttgatatttttcttgctgaatatgtttttatatatatatatatatatatttttttttttaagtatattggagtggaggagttttgtttttttttttaattacccaatattaaaagtatatgaggctgggcacagtggttcatgcctgtaatgccagcactttgggaggccgagtcaggtagatcatttgaggtcaggacttcaagacctgcctggccaacatggtgaaaccctgtctctactgaaaatacaaaaattagccaggggtggtggcaggtgcccgtagtcccagctgctcgggaggctgagtcaggagaatctctttaatctgggaggcaggggttgcagtgagccaaggtcatgccactgtactccagcctgggcgacagagcgagaccctgtctta

SEQ ID NO: 350853 - DNA, 667 bp, Homo sapiens
aaattactgtgttctgattacccttaattcacctaagcatatcaatagccgattattctacttccttgtttgactatctttgcttgtcgtacttttaaaaaatatatctcaaggaaaatgagacatcatgttatggagaattgtagtcctgtacctgttttctaaatgataataatatagagtggaaagctggtcctgcatatatttttagagcaatagtgatttttgatgtatgttacaaacttgtttaatgtttatatattcataatatttggggatttttattttttagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaa

SEQ ID NO: 350854 - DNA, 324 bp, Homo sapiens
attgacaggattaggaacagtggtgaatgtttagaatttacccttttgtactttttgaacttggaactttgtaactttattacatattcacagaattaatagataagcaaaattttaaaaacaaacttgttgattaagaacattatactatttatacaacaaaatgtccctttatatattttttttctgtattagggtggactgcgtagggatattgaaattgaggaatgctgatgtcgaagccagaataggaattgctggttccaagaagaaaagcactcgtgccagattggtttttcgagttaatatcatgaggaaagatgg

SEQ ID NO: 350855 - DNA, 572 bp, Homo sapiens
tgaggcaataaaagctttatttttgctttacagcttaaaacgttaaatgagattttaaaaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggat

SEQ ID NO: 350856 - DNA, 5464 bp, Homo sapiens
  misc_feature (17)..(17): n is a, c, g, or t
  misc_feature (5422)..(5422): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagacagntagagccgagggggatcctgctacgacgacgacctgcagcac

SEQ ID NO: 350857 - DNA, 2192 bp, Homo sapiens
  misc_feature (17)..(17): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaaccaaaaaaaaaaaagtcccacagtagaagaaataatactttctgcgtttcagttagtgctctttatgcaaagcggccaccgtg

SEQ ID NO: 350858 - DNA, 14124 bp, Homo sapiens
  misc_feature (17)..(17): n is a, c, g, or t
  misc_feature (7493)..(7493): n is a, c, g, or t
  misc_feature (10819)..(10819): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350859 - DNA, 14240 bp, Homo sapiens
  misc_feature (17)..(17): n is a, c, g, or t
  misc_feature (7609)..(7609): n is a, c, g, or t
  misc_feature (10935)..(10935): n is a, c, g, or t
tgcaacggaaacttttngctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttcttttttttttttttttctatcctgtacatttagttgaactgtgcggaattgtggtgttggttttgtttacacagccagatttttccttctttttgttttgngatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacaaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttcttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatcnaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttctttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggaaaaaag

SEQ ID NO: 350860 - DNA, 335 bp, Homo sapiens
ccagctgagttgtcaacagagaagccgccagacctgcggccgctgcctgcagaccttcccgttggaggccatcactgccttcatggaccacaagaagctgggctgtcagctcttcagaggccccagccgcggccagggctcaggtgagtaaagccgggtgcagtccccctctcaagttcgagggctgggcttcctgctggaaaggggctgggctggacggcagggcactgagcactacttcccctttctcgctccccatcgggtgcagcctaggcgtggccagggcctgcccgtcctagggcagggaccagtggtggcggtggagggggggcggg

SEQ ID NO: 350861 - DNA, 2355 bp, Homo sapiens
caaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatgggcttcaaacagagcctggcgcacaggaggcactcagtgaatgcttgcaaaatgaatttttattgtaatgcatttaatgaaatagcccagattactatcaggcacctaataagaaacgtgaccgactatttttctcgcttgggggtgcgtgtgggcatgccgtgtctcagtttcacccgccctaaaacgggatcagggatagctgtttcaatgccttgtgggaactcggtgtgattaaatttggtcactaagccaaacgcacgggacactgcctagattgagttaggccgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattta

SEQ ID NO: 350862 - DNA, 2568 bp, Homo sapiens
caaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatgggcttcaaacagagcctggcgcacaggaggcactcagtgaatgcttgcaaaatgaatttttattgtaatgcatttaatgaaatagcccagattactatcaggcacctaataagaaacgtgaccgactatttttctcgcttgggggtgcgtgtgggcatgccgtgtctcagtttcacccgccctaaaacgggatcagggatagctgtttcaatgccttgtgggaactcggtgtgattaaatttggtcactaagccaaacgcacgggacactgcctagattgagttaggccgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccggtgagcaccccgggccctgggcccagcctcccttacctttgaccctcgggtgggacccttccctttgggcatgggcccctcgccctgccttatctccttcgccccgtcctgcccctcaggcccccttctgaccttcggtttcccctctccttcagcaccctcagcccccatcctggccccaccccacgctcaccacccgcttcctccctgcagaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattta

SEQ ID NO: 350863 - DNA, 398 bp, Homo sapiens
gttcactggagtttgcattgtcttggctgttgagtgaagaaaaagagcaggaagtcattacatggtaagcatggggctaatggaggagggaggagtggaagcagaggctggtctaccaggcagctccactgcacctgccccagactgatccaccctcctaaaatctgtgccatcgtcccccaatggcttggatcagaaacaaaagtgtcacatgcacaaaaacatgagccccgtgaaggcaaggacctttgtctgcttttataatgtttttatctcaacttataggcaataaatatttgccaaaagatgaacctggccaggcatggtggctcatgcctgtaatcccagccctttgggaggccaaggcaggaggatcactttgaagctgggagtttgag

SEQ ID NO: 350864 - DNA, 313 bp, Homo sapiens
gattacaggcgtgagccactgtgcctggactaacttgtcctttttcttattaggctcttcctgtctctgcacctgaactgtgagccccttgcaagacaggaccctgcagatagaccaaggatgtgaaccagggctactcagtctggacactattgacatttggggctggataattatctgctatgttgtgggggctgtccaacgcataggtgtagggtttgagcagcatcctagcctctgcctcctattaatagatgccagtagcatcccatcttcaagttgtgacagccaaaaatgtcaccactggtgaaca

SEQ ID NO: 350865 - DNA, 638 bp, Homo sapiens
caaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatggctcttcctgtctctgcacctgaactgtgagccccttgcaagacaggaccctgcagatagaccaaggatgtgaaccagggctactcagtctggacactattgacatttggggctggataattatctgctatgttgtgggggctgtccaacgcataggtgtagggtttgagcagcatcctagcctctgcctcctattaatagatgccagtagcatcccatcttcaagttgtgacagccaaaaatgtcaccactggtgaacagtgaattggtgaatgtgaattgcatctcaatacagtttttttttaaagtctccat

SEQ ID NO: 350866 - DNA, 2726 bp, Homo sapiens
caaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatgggcttcaaacagagcctggcgcacaggaggcactcagtgaatgcttgcaaaatgaatttttattgtaatgcatttaatgaaatagcccagattactatcaggcacctaataagaaacgtgaccgactatttttctcgcttgggggtgcgtgtgggcatgccgtgtctcagtttcacccgccctaaaacgggatcagggatagctgtttcaatgccttgtgggaactcggtgtgattaaatttggtcactaagccaaacgcacgggacactgcctagattgagttaggccgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttatttaaacacaccacatcaaaccctaccctacgacgcttgtcacaacgcacaagccacagccccaacacaccccgccacccacgtcacaaacccatccgaccagcttccccttcccgccgcatgcacccatcgcaccacccaccacttcctaccacagcaaacgcagtcactcccccccgccgccatctactgcagacccaggcgcagctctcccgcggccacccaagaagaggggcgctctcacctgctcaacgccgcggcgcaccatacgtcgacgagaaccaccaaccagcgtccggacgccctcaactagcgggccatccgcacaccgagatcgcgacacacacagtcctctctatgcctcacacgacaccc

SEQ ID NO: 350867 - DNA, 1466 bp, Homo sapiens
caaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatgggcttcaaacagagcctggcgcacaggaggcactcagtgaatgcttgcaaaatgaatttttattgtaatgcatttaatgaaatagcccagattactatcaggcacctaataagaaacgtgaccgactatttttctcgcttgggggtgcgtgtgggcatgccgtgtctcagtttcacccgccctaaaacgggatcagggatagctgtttcaatgccttgtgggaactcggtgtgattaaatttggtcactaagccaaacgcacgggacactgcctagattgagttaggccgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcaggtgagtaaagccgggtgcagtccccctctcaagttcgagggctgggcttcctgctggaaaggggctgggctggacggcagggcactgagcactacttcccctttctcgctccccatcgggtgcagcctaggcgtggccagggcctgcccgtcctagggcagggaccagtggtggcggtggagggggggcggg

SEQ ID NO: 350868 - DNA, 2161 bp, Homo sapiens
tcccacttttcccaaacaaagctcccggcaactttctccctcgcagcgccccgcccgcccgcggctccccagccccaggccgggaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttacca

SEQ ID NO: 350869 - DNA, 800 bp, Homo sapiens
tcccacttttcccaaacaaagctcccggcaactttctccctcgcagcgccccgcccgcccgcggctccccagccccaggccgggaggtaggaaggcgccggcgggagtcggggatcctgctttggggtgtgcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccaggaagaaactccttcccagaagccccccagcagatttcccctaacgtctcattggctaggactgtgtcacatg

SEQ ID NO: 350870 - DNA, 630 bp, Homo sapiens
gggttttgcgggtataattacattcaggatctcaggatactgcattatctgtgtgacccctaaatctgatgacaagtgtctgttttttgtttttgtttttgagacagagcctcgctctgtcacccaggctggagtgctgtggtgtgatctcggctcactgcaacctccgcctcccaggttcaagcaattctctgcctcagcctcccgagtaaatgtgattacaggcaggcgcctgccagcacacccagctgattttagtatttttagtagagatggggtttcaccatcttggccaggctggtcttgaattcctgacctcgtgatccacccacttcagcttcccaaagttctgggattacaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgtgagaatacatttctgttgttctaa

SEQ ID NO: 350871 - DNA, 4002 bp, Homo sapiens
gcccctgtcccccagcttgtggttctgtgggtctctcctggtctcggcctcagctgctgccctgagtctctgtccctgccctttctaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350872 - DNA, 2811 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggtcagagaagtcgaaggggtgctggcgagacgggggtgatgcccacccgggcg

SEQ ID NO: 350873 - DNA, 3730 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350874 - DNA, 985 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccaggaagaaactccttcccagaagccccccagcagatttcccctaacgtctcattggctaggactgtgtcacatg

SEQ ID NO: 350875 - DNA, 1832 bp, Homo sapiens
gggttttgcgggtataattacattcaggatctcaggatactgcattatctgtgtgacccctaaatctgatgacaagtgtctgttttttgtttttgtttttgagacagagcctcgctctgtcacccaggctggagtgctgtggtgtgatctcggctcactgcaacctccgcctcccaggttcaagcaattctctgcctcagcctcccgagtaaatgtgattacaggcaggcgcctgccagcacacccagctgattttagtatttttagtagagatggggtttcaccatcttggccaggctggtcttgaattcctgacctcgtgatccacccacttcagcttcccaaagttctgggattacaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350876 - DNA, 1753 bp, Homo sapiens
gcactctctctctttttttttttgagatggagtctcgctctgtcgcccaggctggagtgcagtggcaagatctcggctcactgcaacctctgcctcccgggttcaagtgattctcctgcctcagcctcccgagtagctgggattacaggcacgccccaccacgcctggctaatttttgtatttttagtagagatggggtttcaccatgttggccaggttggtcttgaactccgacctcaagtgatccacctgcctaggcttcccaaagttctgggattacaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350877 - DNA, 388 bp, Homo sapiens
gtttctcaggtccatgagccacacttgtgctcagtggccacgtggtctgtggtcagtagccacatgtgggcactgggtaccgtattggatggcacagatttccatccaatagaacatttccatccctggaaagttctattggccagtgctgcctccccaccccgactttggcctcctgtcccatctcctgagtgttggtcattttcttcccaccctcccaacccctcagcctcttcttcctccaaattccttgtcttctgcgtcttctccctgccttccaagacttggtttctcttctctcctctttctttttattttttttttgaaatggagtcttgctctgtcacccaggagtataatggcgtaatctcggctcactgcaacatct

SEQ ID NO: 350878 - DNA, 330 bp, Homo sapiens
ctggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacactatatatatcaaaacattattatgggccaggtgaggtggctcatgcctgtaattccagca

SEQ ID NO: 350879 - DNA, 4229 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350880 - DNA, 3654 bp, Homo sapiens
tcccacttttcccaaacaaagctcccggcaactttctccctcgcagcgccccgcccgcccgcggctccccagccccaggccgggaggtcggaatgaactgatcgcccgctacatcaagctgagaacggggaagacccgaactcgaaaacaggtttctagtcacatccaggttttggcccgaaggaaatcaagggaaatccagtccaagttgaaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacggtatcgagcgagccggttgtagacgtggtccaggtttctgcacaggaatatcgagagcgtcatgaacccgagctatagagaaaggagatgaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaactacaaatagaatacctgttactgcatacataaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaa

SEQ ID NO: 350881 - DNA, 1095 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagagttcagaaggaagaaaatgtttcccagaggagtataatggcgtaatctcggctcactgcaacatctgcctcccgggttcaagcagttctcctggcccagccccctgaatagctcggattacaggcgcgcaccaccacactctgctaatttttgtatttttagtagagatgggatttcaccatgttggccaggctggtctcgaactcctgacctcaagtgatctgcccgcctcaacctcctgaagtgc

SEQ ID NO: 350882 - DNA, 688 bp, Homo sapiens
ctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggcctctgagcttttccagttttggtctggaggatctgggcccccctggaatgttccagatgtgaagccattctcacagacaccgttcaccttgtcactgactcccccatctactgacctcccagcggcgaggggctcgtaggggggccggaagagtagcggagaagggggcgccaggcagggtagggcggggaagaggtgacgag

SEQ ID NO: 350883 - DNA, 195 bp, Homo sapiens
gtcggaatgaactgatcgcccgctacatcaagctgagaacggggaagacccgaactcgaaaacaggtctcggaatggacttgtgggcttctgtctgggatgggccggtcttcttagggtcatcctcgcatgggcaggttcaggttcaaggaagaagctgcttcctgtgcgttcatctgtcttctcggcatgtgtg

SEQ ID NO: 350884 - DNA, 2029 bp, Homo sapiens
  misc_feature (22)..(22): n is a, c, g, or t
agcggatggcgagggagcggcngccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggcattacataaaagctgatttatgacattacgttcttcagagtaacaaacccctggaggactctcctgccgggatgtccatcagtaagggtaagctggctgaaca

SEQ ID NO: 350885 - DNA, 2412 bp, Homo sapiens
  misc_feature (22)..(22): n is a, c, g, or t
agcggatggcgagggagcggcngccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggcacccagcaaccatcccctaggagaacaggcaaggaccctcgtgggaagatcccaccacagcaacacctttcttcagggcgggctctctccgcaatgtgtgagtcaagacaatccattccattcaagaccaatttactctcaaattttgccaacacagaaatattatccttaaagaaatgtgcatttaaatcttttaattcacttcatcctgtattttaaaataaatgttttccatatagattttccccttgggggggaaaagaattcagggtcttaggttccaggcagttcaaaaacagccacgcggttcttttttctccaccagaataccacaatagcagaacttaagaatcgggatatgaaaagggaggcgtggtcctggcagtggcccctggccggcaggaatacacagcaacacccaggcaggggcagcggctgccccca

SEQ ID NO: 350886 - DNA, 2492 bp, Homo sapiens
ccatcccccagcccctgggcatgagccctgccagggaaggagcctctccagggctgggggcaagggttgggggcgccggtgggctggcagctgaggtcgaggggaggctcctgcagtcaagggccgtgtgtccagcagggcaggtgccccgaatggagaccagggcttgtggaaaggggccgcttcccagggcttcagccagtgcgtgccctctgccctgtgccgattctcatcctcagggaagctctgaggcttctctgcccaggtgcccacccccgagctccccaggtgcacccaaggctgccaggaggcgggaggtctgtctggcagcagccacacaggccagcagagtgagctgacacattgctggctgcgtcctccacccgtgtagctgtgggctgggacccctaacctggcagatgtgctggtctggccggcagaccaccccgccaggaggaccaggtaaaggccaggtcgtgctcccagacatcaaatcaactggcttttcctttcttttggtcccaaacgccaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggcacccagcaaccatcccctaggagaacaggcaaggaccctcgtgggaagatcccaccacagcaacacctttcttcagggcgggctctctccgcaatgtgtgagtcaagacaatccattccattcaagaccaatttactctcaaattttgccaacacagaaatattatccttaaagaaatgtgcatttaaatcttttaattcacttcatcctgtattttaaaataaatgttttccatatagattttccccttgggggggaaaagaattcagggtcttaggttccaggcagttcaaaaacagccacgcggttcttttttctccaccagaataccacaatagcagaacttaagaatcgggatatgaaaagggaggcgtggtcctggcagtggcccctggccggcaggaatacacagcaacacccaggcaggggcagcggctgccccca

SEQ ID NO: 350887 - DNA, 2542 bp, Homo sapiens
  misc_feature (22)..(22): n is a, c, g, or t
agcggatggcgagggagcggcngccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggcacccagcaaccatcccctaggagaacaggcaaggaccctcgtgggaagatcccaccacagcaacacctttcttcagggcgggctctctccgcaatgtgtgagtcaagacaatccattccattcaagaccaatttactctcaaattttgccaacacagaaatattatccttaaagaaatgtgcatttaaatcttttaattcacttcatcctgtattttaaaataaatgttttccatatagattttccccttgggggggaaaagaattcagggtcttaggttccaggcagttcaaaaacagccacgcggttcttttttctccaccagaataccacaatagcagaacttaagaatcgggatatgaaaagggaggcgtggtcctggcagtggcccctggccggcaggaatacacagcaacacccaggcaggggcagcggctgccccca

SEQ ID NO: 350888 - DNA, 1841 bp, Homo sapiens
  misc_feature (22)..(22): n is a, c, g, or t
  misc_feature (1697)..(1698): n is a, c, g, or t
  misc_feature (1713)..(1713): n is a, c, g, or t
  misc_feature (1721)..(1721): n is a, c, g, or t
  misc_feature (1724)..(1724): n is a, c, g, or t
  misc_feature (1729)..(1729): n is a, c, g, or t
  misc_feature (1731)..(1731): n is a, c, g, or t
agcggatggcgagggagcggcngccgctgcgggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgaaaaaanncacacccaaaacaancaacaganaanaccananacaaaccacaggagggggggtggacaggggacggcgccaccccccggaaggatcggcgcagggggacggggagggagagggcgacgggcgacgcacgccgggcgcggccg

SEQ ID NO: 350889 - DNA, 2271 bp, Homo sapiens
ggctagtacgaggctggggttagcattgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggcacccagcaaccatcccctaggagaacaggcaaggaccctcgtgggaagatcccaccacagcaacacctttcttcagggcgggctctctccgcaatgtgtgagtcaagacaatccattccattcaagaccaatttactctcaaattttgccaacacagaaatattatccttaaagaaatgtgcatttaaatcttttaattcacttcatcctgtattttaaaataaatgttttccatatagattttccccttgggggggaaaagaattcagggtcttaggttccaggcagttcaaaaacagccacgcggttcttttttctccaccagaataccacaatagcagaacttaagaatcgggatatgaaaagggaggcgtggtcctggcagtggcccctggccggcaggaatacacagcaacacccaggcaggggcagcggctgccccca

SEQ ID NO: 350890 - DNA, 2448 bp, Homo sapiens
gcggggctgcccctgcagccgacagccccatcctgcagccaccaatggcatgacccagggccccggcactgcctgtgtgaggggctggcagctttccaactgcagcaagtggaggcccctgccagcttcgggcctgtgggcaggggctcagtggggcaggggtgtggctgccccgcccggcacgcctgcacctgtctcctcagtgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcggcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggcacccagcaaccatcccctaggagaacaggcaaggaccctcgtgggaagatcccaccacagcaacacctttcttcagggcgggctctctccgcaatgtgtgagtcaagacaatccattccattcaagaccaatttactctcaaattttgccaacacagaaatattatccttaaagaaatgtgcatttaaatcttttaattcacttcatcctgtattttaaaataaatgttttccatatagattttccccttgggggggaaaagaattcagggtcttaggttccaggcagttcaaaaacagccacgcggttcttttttctccaccagaataccacaatagcagaacttaagaatcgggatatgaaaagggaggcgtggtcctggcagtggcccctggccggcaggaatacacagcaacacccaggcaggggcagcggctgccccca

SEQ ID NO: 350891 - DNA, 1544 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350892 - DNA, 2067 bp, Homo sapiens
  misc_feature (676)..(676): n is a, c, g, or t
  misc_feature (1154)..(1154): n is a, c, g, or t
  misc_feature (1364)..(1364): n is a, c, g, or t
  misc_feature (1470)..(1470): n is a, c, g, or t
  misc_feature (1475)..(1475): n is a, c, g, or t
  misc_feature (1488)..(1488): n is a, c, g, or t
  misc_feature (1518)..(1518): n is a, c, g, or t
  misc_feature (1522)..(1522): n is a, c, g, or t
  misc_feature (1529)..(1529): n is a, c, g, or t
  misc_feature (1536)..(1536): n is a, c, g, or t
  misc_feature (1563)..(1563): n is a, c, g, or t
  misc_feature (1570)..(1570): n is a, c, g, or t
  misc_feature (1578)..(1578): n is a, c, g, or t
gctttactgggtcccttctctcttcattcacagggggccctccctttagatctctgtctattcagacaggcggccctttctcagatgggatatagacagatgatcttttgaaataagtgagaagatttttaagattagaataatatgaagaatatctttctggccgggcgacgtggcttatgtctgtaatcccagcactttgggaggctgaggtgaggggattgcttgaacccaagagttcaagaccagcctgggcaacatggcgagaccctgtctcgaagaaaatacaaaaattagctgcatgtggtggtgcatgcctgtagtcccaggtactgaggaggctgaggcaggaggatcctttgagcccaggaggtcgaggctgcagtgagccgtgatcacaccagtgcactgcagcctgggcaacagcatgagaccctgtctcagaataaaaaagtgtttctttctcagaagacagagtacagaagatgtttgtttttgttttttctctctctgtgctacaggggaaggtgtggctcattgactttaatccatttggtgaagtcacagattcactgctgttcacctgggaagaactgatatctgagaacaacttaaacggcgattttagtgaagttgacgctcaagagcaggtacaacatttttaagacagatacantgtaaacctttccagtctactgactgactgcttgttcttcagacgcataggtaggcggcaatggccaggacccttgggaagcgcagagtgtaacacagctttactaatagctaacctgcccatggtggtggtcaaagaagggggccccacttaactttatatacagaagtcaggatcatctgatcagtttttttagttctttttctgagcttcttctgtcacacccacctggaggaatcttggtcccagatcagctcatgcatctgttccttctgaccccagccccagctgctgaggccgacagagaagttacacacgtgcagcccagcggattcctgtcagctttctcctccatttccacggtgactggctcacgccttgatgcttctcagtctcccatcattccttccttcctctcagcagatgatttaacttgctgtttcccggaaaagggaacccactgatgagaattccctcngttgatttctcatcacacctacaagcttgtccgtcccttcctgagtctaatctcccccctccatacacttgtgtccccctctgtcatctccccactctggacactgtgtcctcctctgtcacctcccccctcagtacactgtgtcttcctctctcacctccccctcaggacactgtgtcctcctctctctcacctccccctcaggacacngtcctcctctctcacctcccactctggacactgtgtcctctctcaccgcccactccggacactgtgtcctcctctctctcacctccccctcaggacactgtcctcntctcncacctcccactcnggacactgtgtcctcctctctcacctcccnctcnggacacngtgtccncctctctcacctccccctcaggacacngtgtccncctctctnacctccccctcaggacactgtgtcctcctcctctttctccagatgccctctgctctttttgcaattcttcctctctatcaactctgtccatccggatttagtcatgttcagatacctcccatccgaaaaaaacaaaacattgttcaacccggtttcttcacccagccactctctcctttcctgccagcttcacagccagactttcctgaaacaactttgtagtgctgttttctgcccataaaagtaacatgtccaagacgggcggatcaggaagtcagggtatcgagaccatcctggctaacacggtgaaaacctgtctctactaaaaatacaaaaaaaaaattagccaggcgtggtggcgggcgcctgtagtcccagctacttgggaggctgcggcaggagaatggcatgaatccgggaggcagagcttgcagtgagccgagattgtgccactgcactccagcctgggcgacagggcaagactgtctc

SEQ ID NO: 350893 - DNA, 921 bp, Homo sapiens
  misc_feature (889)..(889): n is a, c, g, or t
  misc_feature (891)..(891): n is a, c, g, or t
acagctctgatccactcaacaccaccaactctactctcgcgcgacccctcacggcatacaacccaccactatacagagttccggagcgcaccatcccagtccgccgtttaccacacaactctctcccgcgccccgggcccgccctaatcgtctcccaactcctaggtcgctctcggtcccgggcgcataagtccgcgttacttgcagcgtactcgccacattcagtaatatacacgccgcgcccgacaccgccgctaatccccttttccaacaaagacagccaattacggcacgcgcccagacctgttttccaagcgccccacccagtcccaattctcacatttcaggcttggggtcgtaataaccaaaaaccataggggccaggtttggtctcttggccttgcaccactttggtaatactcacattcccccctgttccctctgagcagcctctatattttatacaacattcacccgccccttttaagtaaagttcccgctcaagagcgattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatagctgatgcggcaagccncnttccctcccctcccaccacgcatcctcccc

SEQ ID NO: 350894 - DNA, 539 bp, Homo sapiens
atgtgaatatttatatttttgtgtggatttctgtgtaggagtttttgtatgtatggaagaaagagaagaaaatactcaaatacctgaggataatttgctcaggagtcaaagtgataaactagtttaatgaattaaagcatggttttccatgacaatttttaattacatcctttgccaagacctctagaaaattacacctgctgagcagatatcccaaggagcatgtgctattttaagatccccttggttttctttgacagaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350895 - DNA, 2191 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaataaaaaaaaaaaaaaaaaacttgggggcttttatggcaggggtgcgcggaaacgacgcaggttactgtgaacgtgcacccctgtggcccattatccggttttcccgtgaccccagtcttctcttgttctcacacgctgctagaatctgccgcggctccccccttatagggagcccgcaattaaaattcgcgaataaggccggtttaccccgcttaagtctcccccccacaaaaaaccgctcaactacatgatcaaacaacacatccgagtcaccagagtcaatcaatagaccggacgggagtttctcgcaccccacttctgcttctcccaccaaatacgtccggctgctcgcgtacacaccacatttttcaaccctttgtcgtccctctacttaaccaactctcctcttatccacgccccacaatctatacttactcagctcgacacgtcgctgatcacacttcttatccgacctccctatactcaccgccgactttcttactcactctttctaccctaccgcctcgctcacccgacaaagcacaacacactaagaaacactcctagctaaaccccacttcaattacaccaaatctccagtaacacacaccgactcacattcaaaccaagtaaatactacacacacaac

SEQ ID NO: 350896 - DNA, 1617 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagacttcttactctgtcagccaggctggagtgcagtggtgcgatcgcggctcgtgcagcttccacctcccgggttcagttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350897 - DNA, 1703 bp, Homo sapiens
  misc_feature (1494)..(1494): n is a, c, g, or t
  misc_feature (1496)..(1497): n is a, c, g, or t
  misc_feature (1502)..(1502): n is a, c, g, or t
  misc_feature (1507)..(1507): n is a, c, g, or t
  misc_feature (1515)..(1515): n is a, c, g, or t
  misc_feature (1524)..(1524): n is a, c, g, or t
  misc_feature (1526)..(1526): n is a, c, g, or t
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttngnnacctntgttngtataaangtttttgananaaaaaagggggggttaaataccgagggcaggtacgtaccaggtttgtaaggggacaagggggttaaaaagcaggggggtaaactgtgggaaaagaggggttggaggcacacttggggtggagccaagaaaatgataatagatgagcatgggtgttaggttaattaattaataatatg

SEQ ID NO: 350898 - DNA, 1406 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcagaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350899 - DNA, 1125 bp, Homo sapiens
  misc_feature (329)..(329): n is a, c, g, or t
agcataataagaagtgagatgaagtaagcagatctgaggattagagcactactgaggtctctggaaatagaaatcgcctagaattcgttacctcaccatgaggcacgctctaatcctgctcgctggaggatttcttccctatctcaatgctgacctggggacgagaaagactgtagaatctgaatgagtggtacatcatgaatgtgtgaagctcgatcagggatgagtgctggcgtgcctgttgtgaggagcttgcagcaagtgcaatccacatcgttgcatgttttcaatctacgccgtgccatccagttgctactgatgattctccnagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350900 - DNA, 1415 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350901 - DNA, 1714 bp, Homo sapiens
gctttactgggtcccttctctcttcattcacagggggccctccctttagatctctgtctattcagacaggcggccctttctcagatgggatatagacagatgatcttttgaaataagtgagaagatttttaagattagaataatatgaagaatatctttctggccgggcgacgtggcttatgtctgtaatcccagcactttgggaggctgaggtgaggggattgcttgaacccaagagttcaagaccagcctgggcaacatggcgagaccctgtctcgaagaaaatacaaaaattagctgcatgtggtggtgcatgcctgtagtcccaggtactgaggaggctgaggcaggaggatcctttgagcccaggaggtcgaggctgcagtgagccgtgatcacaccagtgcactgcagcctgggcaacagcatgagaccctgtctcagaataaaaaagtgtttctttctcagaagacagagtacagaagatgtttgtttttgttttttctctctctgtgctacaggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaataaaaaaaaaaaaaaaaaacttgggggcttttatggcaggggtgcgcggaaacgacgcaggttactgtgaacgtgcacccctgtggcccattatccggttttcccgtgaccccagtcttctcttgttctcacacgctgctagaatctgccgcggctccccccttatagggagcccgcaattaaaattcgcgaataaggccggtttaccccgcttaagtctcccccccacaaaaaaccgctcaactacatgatcaaacaacacatccgagtcaccagagtcaatcaatagaccggacgggagtttctcgcaccccacttctgcttctcccaccaaatacgtccggctgctcgcgtacacaccacatttttcaaccctttgtcgtccctctacttaaccaactctcctcttatccacgccccacaatctatacttactcagctcgacacgtcgctgatcacacttcttatccgacctccctatactcaccgccgactttcttactcactctttctaccctaccgcctcgctcacccgacaaagcacaacacactaagaaacactcctagctaaaccccacttcaattacaccaaatctccagtaacacacaccgactcacattcaaaccaagtaaatactacacacacaac

SEQ ID NO: 350902 - DNA, 527 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaaggtaaagtattttagaaaaaaatttcttaaactttatcataaagaaacacataaaatgaatgaattagcttaggcaccattctttccctttagctcttttt

SEQ ID NO: 350903 - DNA, 1438 bp, Homo sapiens
gtgcgtttagggcgaagacggagttgtaaacttcttaaaattcctctctcgacacttcgggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350904 - DNA, 1577 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaataaaaacaaaataggcggacggccaaagatatccg

SEQ ID NO: 350905 - DNA, 2675 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaatacaaaaaaaaaaaaaaacaacaaaagaaaaaaaaaaaaacaaaaaaaaagaggggggcccgcccacgaagatatccccccggggggcgccccaggtgtagcgcgtgtcccccgagttttgtgtggccaccaggggggccccccaagggaggagacccggcttacaataacaaacagctaggcaacgtgggcgccgcgtgtataacaaacaccccgtcgtggcaccggggagcaacacagcggtacaccaccgagggcgcaacacttggcggaagcgaggaccaccgccctaccacactctaggagaggggagccacaacaaaataggtgggcacaccaacaccaccctaacaagacggagacttccagagccgccccccaggggcgcacaatcataccaacaaacagcacaagaggggtacgataacggcggtcgtcaaacacaacaaccccgaacaataagcgtccgccgcacgggagctgcgacaaaatctagcgcggccacacccccgcgaatctcgcgaatcgcggaaaaacacaaatttaacaccacgggggcgcgcggcagaccgacacacgtatcgtcccaacgaacacgacacccacgtacgcacgcagcagagcagcgacaaaagcacaaaaagaatacagaagagggagaggccacggggaaggggcataggcggacacataacatacagcacggacgacgacacacgccaagacaaccagaaccggactacgaacaagcagaaccggaccgccgcccgagcccgccgcacgccgaaaaagcccgggagcgctagccagagcccagagcgcagactagggaagcggagggcggaggacgcagggacaacccgcctggagcacgagccgcaggcagcacagacaccgcacgagggcgccgcaagggagaggaacgcggcgacagagacgccaacggacccgcgcggcggccagcgcaaggacgcgcgacgagcacgaatgagcagacggcgagcacgcgccgcgcaccgccgagacactcgggggctggcacagcgcgagggcaagaagcgccagggcgaagagggcgagaggcgcgcagtccgcaacggccgagagcggcagcgagcgggaagaagacaggc

SEQ ID NO: 350906 - DNA, 1448 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350907 - DNA, 2544 bp, Homo sapiens
  misc_feature (1153)..(1153): n is a, c, g, or t
  misc_feature (1631)..(1631): n is a, c, g, or t
  misc_feature (1841)..(1841): n is a, c, g, or t
  misc_feature (1947)..(1947): n is a, c, g, or t
  misc_feature (1952)..(1952): n is a, c, g, or t
  misc_feature (1965)..(1965): n is a, c, g, or t
  misc_feature (1995)..(1995): n is a, c, g, or t
  misc_feature (1999)..(1999): n is a, c, g, or t
  misc_feature (2006)..(2006): n is a, c, g, or t
  misc_feature (2013)..(2013): n is a, c, g, or t
  misc_feature (2040)..(2040): n is a, c, g, or t
  misc_feature (2047)..(2047): n is a, c, g, or t
  misc_feature (2055)..(2055): n is a, c, g, or t
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggtacaacatttttaagacagatacantgtaaacctttccagtctactgactgactgcttgttcttcagacgcataggtaggcggcaatggccaggacccttgggaagcgcagagtgtaacacagctttactaatagctaacctgcccatggtggtggtcaaagaagggggccccacttaactttatatacagaagtcaggatcatctgatcagtttttttagttctttttctgagcttcttctgtcacacccacctggaggaatcttggtcccagatcagctcatgcatctgttccttctgaccccagccccagctgctgaggccgacagagaagttacacacgtgcagcccagcggattcctgtcagctttctcctccatttccacggtgactggctcacgccttgatgcttctcagtctcccatcattccttccttcctctcagcagatgatttaacttgctgtttcccggaaaagggaacccactgatgagaattccctcngttgatttctcatcacacctacaagcttgtccgtcccttcctgagtctaatctcccccctccatacacttgtgtccccctctgtcatctccccactctggacactgtgtcctcctctgtcacctcccccctcagtacactgtgtcttcctctctcacctccccctcaggacactgtgtcctcctctctctcacctccccctcaggacacngtcctcctctctcacctcccactctggacactgtgtcctctctcaccgcccactccggacactgtgtcctcctctctctcacctccccctcaggacactgtcctcntctcncacctcccactcnggacactgtgtcctcctctctcacctcccnctcnggacacngtgtccncctctctcacctccccctcaggacacngtgtccncctctctnacctccccctcaggacactgtgtcctcctcctctttctccagatgccctctgctctttttgcaattcttcctctctatcaactctgtccatccggatttagtcatgttcagatacctcccatccgaaaaaaacaaaacattgttcaacccggtttcttcacccagccactctctcctttcctgccagcttcacagccagactttcctgaaacaactttgtagtgctgttttctgcccataaaagtaacatgtccaagacgggcggatcaggaagtcagggtatcgagaccatcctggctaacacggtgaaaacctgtctctactaaaaatacaaaaaaaaaattagccaggcgtggtggcgggcgcctgtagtcccagctacttgggaggctgcggcaggagaatggcatgaatccgggaggcagagcttgcagtgagccgagattgtgccactgcactccagcctgggcgacagggcaagactgtctc

SEQ ID NO: 350908 - DNA, 1067 bp, Homo sapiens
gctttactgggtcccttctctcttcattcacagggggccctccctttagatctctgtctattcagacaggcggccctttctcagatgggatatagacagatgatcttttgaaataagtgagaagatttttaagattagaataatatgaagaatatctttctggccgggcgacgtggcttatgtctgtaatcccagcactttgggaggctgaggtgaggggattgcttgaacccaagagttcaagaccagcctgggcaacatggcgagaccctgtctcgaagaaaatacaaaaattagctgcatgtggtggtgcatgcctgtagtcccaggtactgaggaggctgaggcaggaggatcctttgagcccaggaggtcgaggctgcagtgagccgtgatcacaccagtgcactgcagcctgggcaacagcatgagaccctgtctcagaataaaaaagtgtttctttctcagaagacagagtacagaagatgtttgtttttgttttttctctctctgtgctacaggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtgctggaactggagaagaggaggccccgccccaccgctccgggagctgctcatcagccgcaacttcctgccgaccctgatgcgggtgggccgagcagtgtggacatcagccgctttttatattcatgtacattcacctggggaaaaaaacggagggactttgctacttgtaaaaataacataataaatagatcttaaacataggaaaaccatactgttctgataataaaatgctttctatgaaata

SEQ ID NO: 350909 - DNA, 883 bp, Homo sapiens
gtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttcactttcacattctgcccttacttagctgctctttcttttctcgttcctccctatttcatgcctcctccccctcttgctccgccatatcctccattcttcccctgtccgcatctccctccttctcctctccctcttctctctctttctctcccgttctctcctttctcctccccctctcttccctcccttttc

SEQ ID NO: 350910 - DNA, 7931 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350911 - DNA, 5363 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctacctt

SEQ ID NO: 350912 - DNA, 972 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctggatgacacgtggaataaattgcacattaaaatgtctgacatgaaaatcagaagagcttaagttcattccacagaagccttttgttagaatcttcaaaggatgagaaccaggatgaagaagagtttacagtagggaagtatttctcaactgtaattgtacataaaaattgcctatggtgctttaaaaaaatacagagtctggggacacatgttctcgggatctcctaagggctgtcacagaccataaagtttaagaa

SEQ ID NO: 350913 - DNA, 372 bp, Homo sapiens
agctgggtgcagtcacccctagacttggatgtggagtgagtacccctgttgactttaacatctgtgtgtgtcttaaagaagactgctacttttctggtttattgtctatgcctacagatgacacgtggaataaattgcacattaaaatgtctgacatgaaaatcagaagagcttaagttcattccacagaagccttttgttagaatcttcaaaggatgagaaccaggatgaagaagagtttacagtagggaagtatttctcaactgtaattgtacataaaaattgcctatggtgctttaaaaaaatacagagtctggggacacatgttctcgggatctcctaagggctgtcacagaccataaagtttaagaa

SEQ ID NO: 350914 - DNA, 761 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctggtttcagctacttgggaggctgaggcagagggatcattcgagcta

SEQ ID NO: 350915 - DNA, 7723 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgatacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350916 - DNA, 8279 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaaccctttaaaaaaaaaaaaaaaaaaaaaaaaaaaaaaatttgtggggcgccggcatcggcacctcgaaaaaagttctccaagagaccccactccggtgtgggggcgccggcggcgcccaaggtaggtgtcctgccagacacagtggcgccaaaaggtaggtccccaaaaggaagacacccgggcgcccgcggaactagggtggcggggttttctcccaccaaataaaaaaacgcgccgcggggggacaccccgggtgtccggaaacaaatcccaaaatgtcgcgtccggaagcgccaaagcgcgctccaaccccagggaggccaagcggagcggaaaaaaatacacaggggaaggg

SEQ ID NO: 350917 - DNA, 5195 bp, Homo sapiens
cgctaagccttcaaaatccagtgtgtatctcacgtttatagcacatctcaattcagactcaccagccacatttaaagtgctcagtagccacatgtgacagcagctaccaacctggcaacacaggtctaaagaatctctttaggttgtttatattttagtatttctctcaggtgatttgtgtcttttgccatctctgtcttcctgccttagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350918 - DNA, 4566 bp, Homo sapiens
gagtcttggccctgtgttaaattggtttccgcaagttaccggcgggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350919 - DNA, 2275 bp, Homo sapiens
  misc_feature (17)..(17): n is a, c, g, or t
gaacaaaaaaaaaaaanaaaaaaaaaaaaaaaaagaaaaaaaaaaaaaagaaaaaaaaaaaaaaaaaaaaaaaaaaccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350920 - DNA, 1989 bp, Homo sapiens
  misc_feature (18)..(18): n is a, c, g, or t
tagggggggagggtgtanaaaagggggggcgggggaccgggtccggaattcccgggatcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350921 - DNA, 5309 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaggttttatctaataaagtgtctcttccattcacgttgctacctt

SEQ ID NO: 350922 - DNA, 3596 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagagtgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350923 - DNA, 3646 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagagtgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggtttcgccctgtggtacatgtgtacgcaaaccgctttcttatcaaacggcattagcccctcacaaagaaacgacacatctcttcgtgggggtccgccccctcgctcacgcatgcatcgagcatctccacccctgaccc

SEQ ID NO: 350924 - DNA, 2231 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggagcacagatgcatcaggatcctctaga

SEQ ID NO: 350925 - DNA, 496 bp, Homo sapiens
gttctgatttaaaatttggtttttattacctttgtgaccatcaggagattgcatactggttctcaggcattgcttttaattaccagttatctttctttaacacattgattttacttacgtatctggccgaatttttgtttgacaataggcattttacattttaggctctctaagcacacagtgtgatagttacggcagatgcagctgtaagccaggagtgatgggggacaaatgtgaccgttgccagcctggattccattctctcactgaagcaggatgcaggtaaaatattttcaaagccagaagaagggggcagaatctatatatagtcaacacatattaatagatcttatggcttattggcagcagggtaaacatttttcctgtaataattgtcaacaagactgaggactagctgtaatggtgagccacaaggggtttggcttgtacagagagtaagcagagttttaatgggatgactatcttaaactgaaac

SEQ ID NO: 350926 - DNA, 546 bp, Homo sapiens
cgaaagcatctaatcaatatgatgtcgtagaaagtgtatgccattaaatgtttatcatttgctgtctgtatgaccccaactaaaaatagcaataatagaacagaagtttccaggattaaagaagaggatacaaatgaaagtgctagataaaatacaaaatgttattatgtgggtagtaattttttttatgattatttataacccaaattgataatgtaagtcatgagatagtataaatcaatatattattatttctggattatatttttaagacattttataaattataaaaggagcgggagcatacttgagaaaaaggaaagcttttttaaaaaaagtacaattttcttttgtgcctagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggtaagaggttttggtatatttgctcat

SEQ ID NO: 350927 - DNA, 454 bp, Homo sapiens
tcaaatgtgtccttgaacttgtttcagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggtaagaggttttggtatatttgctcattggcagaaagtgaacagtgtttaataataaagatcccccac

SEQ ID NO: 350928 - DNA, 8001 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaaggtacgcatgattgaacagtgcatgacttctgtgagatggaccaatctttagatgtggctcctaaagcaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350929 - DNA, 8262 bp, Homo sapiens
  misc_feature (86)..(86): n is a, c, g, or t
  misc_feature (7966)..(7966): n is a, c, g, or t
  misc_feature (7984)..(7984): n is a, c, g, or t
  misc_feature (8043)..(8044): n is a, c, g, or t
  misc_feature (8048)..(8048): n is a, c, g, or t
  misc_feature (8060)..(8060): n is a, c, g, or t
  misc_feature (8068)..(8068): n is a, c, g, or t
  misc_feature (8072)..(8072): n is a, c, g, or t
  misc_feature (8095)..(8095): n is a, c, g, or t
  misc_feature (8098)..(8098): n is a, c, g, or t
  misc_feature (8109)..(8109): n is a, c, g, or t
  misc_feature (8116)..(8116): n is a, c, g, or t
  misc_feature (8120)..(8120): n is a, c, g, or t
  misc_feature (8124)..(8124): n is a, c, g, or t
  misc_feature (8126)..(8126): n is a, c, g, or t
  misc_feature (8134)..(8134): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaaccctttaaaaaaaaaaaaaaaaaaaaaaaaaaaaaaaaaccntgtgtgcggggcgcgccncgggcccccggagaaaaccttttcaaaacaccattccggggggggccgggggccccagnngggnaaggggaaacgnggccaaangggnttcccaagggaaaaccggggcanagnaaaaggggcgngggattntccnccanantaaaaaanccgccggggggaacacgaactgttttttgaaaaattccccaaatgggcgttccgaggggcaattacgggggactttactaaagaggggtcccaaaggagctcagtttaaaaataccccctcctggtta

SEQ ID NO: 350930 - DNA, 5573 bp, Homo sapiens
gtagtttatagtttaaacaaaagcgattagattgcctttgtaggactaacattagccacaagattaggggttacggttttaggagcatgcagctggaggctacaagattctgaccctccctaaactgctcctaagaccagtgcttgagatattttacagaccctgcatttgatagagcggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctgcccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaagttttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttttggcaattgttggagctggataggtaagttttataagggagtacattttgactgagcacttagggcatcaggaacagtgctacttactggtgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggtgtgctgttgcaaagttttcacgtcatcgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccagggtggttaataaaatgcaacacttggcatttttatgttttaagaaaaacagtattttatttataataaaatctgaatatttgtaacccttta

SEQ ID NO: 350931 - DNA, 4503 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattgtgataggcgcctgctcggatgaacaagatcgtccgcacgaggacgccactaaggaagattaataccactccatcagagaattctac

SEQ ID NO: 350932 - DNA, 3155 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgctctccagggtggttaataaaatgcaacacttggcatttttatgttttaagaaaaacagtattttatttataataaaatctgaatatttgtaacccttta

SEQ ID NO: 350933 - DNA, 1947 bp, Homo sapiens
  misc_feature (86)..(86): n is a, c, g, or t
gcgcactcgggcacgcgctcggaagtcgggggtcggcgcggagtgcaggctgctcccggggtaggtgagggaagcgcggaggcggngcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattggtaatttagacctcatcccccaacctgttagaactgtgagattacacttaaaatatttttaaaaataaaatcagtgactcttta

SEQ ID NO: 350934 - DNA, 454 bp, Homo sapiens
gatcctccttaaggcagaaaagtggatattatctctgttaaaagggaaggaaatggaaggctcggctaattaaggtgcctaccgtctctacaccagtatgcagaggaggacacaactcaggtcgtctgttccagggcctggactctttagcacagagccctcctatggctctttgtggtgaggttagattgcagagagccctgaaagccaggcagacaaatttataaataaacagagttgataaacaatgggagctctttgcacatttctttattgatttttgatttaagaaataatacatgttcaatgttaattttctgaattcaataactgtattgtagttacgatgttaacatctggggaagctacatgaagggtatatagaaatttttgtattagttttataactttttataagtctgaaattattacaaaacaaactttaaaaaataaa

SEQ ID NO: 350935 - DNA, 1963 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350936 - DNA, 579 bp, Homo sapiens
gttgaagaggctccctcagagctgggctcctctactcatcttcagagtgttaagcttagaactgagtcacctccctcattctcagggtgtctgggccaagatccggtcttactgtctctcctgatttgcctcctgcttcttctaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350937 - DNA, 618 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcagggtaagtgtggctgggtggccaggggtgagccaactggacacactcagacagacacacagacaggtggaggccctgctctgctctactcctactcctgaagggtccgtgctcttcctcttctggtcttgttcccagagccctttccccgcctgccccttcgttctccatccacttcaccactgccttcctccttctgctcccccttgtccagaatctctctctcctagcatcccccacctgccatatagacacactgttagctttttgagtttccgctgaccccaatccagtctttccaacacttcccacactgccccatca

SEQ ID NO: 350938 - DNA, 2316 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350939 - DNA, 1745 bp, Homo sapiens
ccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350940 - DNA, 2032 bp, Homo sapiens
ccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350941 - DNA, 1902 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccagggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350942 - DNA, 2146 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350943 - DNA, 2013 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctgactgagataacccacattgttggagagacagctgcctttctatgccccaggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350944 - DNA, 2035 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctgtggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggacaggcgtccaggtgagtaggacatccagaagatttggacttggagatgtttccccctattttgagtgtccagattaagagctggctgccctagtcattttaaaacatgctgggaatccaagttgggtctcctcattttaatgatgtctaggctgagggctgggcctttcattcttgagtccctgggctcagaagtgggtctctttccctcctctcagggtactgagggaaggaccccaggtggacttcccttcagggtatta

SEQ ID NO: 350945 - DNA, 1486 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagacctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350946 - DNA, 1024 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagacctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350947 - DNA, 1290 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctgtgagttggggagggtggcactgatgacacatagggatcctg

SEQ ID NO: 350948 - DNA, 2218 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctgtggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350949 - DNA, 2603 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350950 - DNA, 2250 bp, Homo sapiens
ctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350951 - DNA, 1292 bp, Homo sapiens
gcctactactactaaattaaaagccggtcgaccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350952 - DNA, 1638 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350953 - DNA, 1594 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccgggtaagtgccccacctgcctgttggtctgacactcatgaccctttcttgactctgcctagtcctcatgtcccgcccctcccatccttgcccgctctgtccgtaatcctcacctctctatctgtcctaaccgtctaactatccttattcaacagaaaattcaactggtatgttttgagcatctgccaagtgccaggtctattctaggctctgggatacagcagtgctaatgccaggcaaggtgcctgccttcaaagagcttacatcttagtggggaagacaataagcaaaggagaatcttgccagatagtaatacctgcagggcagaaaaaccaaagtgagggatgtcgaagaggacaactgagtggttactttttttttttttttttccgagagtctcactctgttgcccaggctggagtgcagtggtgcaatctgggctcactgcaacctctgcctcctgggttcaagcaattctcctgcctcagcctcccaagtagctgggattacaggtatgcg

SEQ ID NO: 350954 - DNA, 1145 bp, Homo sapiens
ctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctggcggagccacccccgctgcgggggcccagggcgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaaaaaatatccaatg

SEQ ID NO: 350955 - DNA, 2864 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttc

SEQ ID NO: 350956 - DNA, 3161 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350957 - DNA, 2895 bp, Homo sapiens
gggcctccgccacctcctcacgcttctgctggaccgaatccttggaatggacagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350958 - DNA, 2756 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcaggtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350959 - DNA, 2509 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggactcttcatccgtgaacttcatgtttattggagccctactaagtgctcagcgtgtggcactgggtagatgggggagagtca

SEQ ID NO: 350960 - DNA, 2632 bp, Homo sapiens
ctgtgtcccaccttcttcactggggagaatacatatagggatctcaagacttttcccccaggttcttcatgacagccagattccccgtaatggaaaagggcagcaagttggagacagagcattccgctgtggctacaagggctgtgggcgtctctacaccaccgctcatcacttaaaggtaaggttgctggcagacagccgtcagctctgcagtcttccctcccaggctgtaattctacctttctgctttgattggaattggtccctgccctcacgttgctggagggaagaaatgagggtacacaggaatgccagcacagagcgcttgacacacatgaatggtacaggagggaagagaatcagggtcctaaagaaaaccaaagagccctggtcatacccttgctcctctgaattatgtgattgcttgtcctcacaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350961 - DNA, 296 bp, Homo sapiens
ctgaattatgtgattgcttgtcctcacaggtgcatgaacgagctcatacaggtgaccgtccatacagatgtgacttccccagctgtggaaaggcctttgccacaggtaacctgcctggtgggctgcttccagttgagggtggagggttctcgttctgtttgggacctctctgaagggaacccaacaccaggctgctttcctggagaaactaccgtcagagtactctgacttgcagggtgctctctctggaggaaaccttgttacgggagtgcaaggcagcatggttcaggccagca

SEQ ID NO: 350962 - DNA, 2699 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttc

SEQ ID NO: 350963 - DNA, 3048 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350964 - DNA, 3161 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaaggtgagggcaccccaacacaccatgccttgtcgagggaagcctgacagcccccaccaagggacccctccatggcactgagctccagggaaaggcaggcattgctctcgttacagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350965 - DNA, 2374 bp, Homo sapiens
ctgtgtcccaccttcttcactggggagaatacatatagggatctcaagacttttcccccaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaacaacaacaccaaaaccacaaaaacaagacggcaccgacgagacggagcgcggcgagagggcggaaggcgcgaggccgcccggcgcgaggcgcagcagcgggcggcgccgaggacagaggggaggaggggggggcgacggaaaatcacgcgcgcaaggccacacgccagcagacaaaaagccgaaaaagaaggggccagccacaacgacagaacaacagcgaacaaccgagcagaaagcacacgacagcgacaagcacgaagaagaacgagacaacccggga

SEQ ID NO: 350966 - DNA, 1935 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtatgaccaggcggtttgcttgggg

SEQ ID NO: 350967 - DNA, 1892 bp, Homo sapiens
gggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggtgggctagctggcatgcgaggactaccctcactcaggccccaacccctctactgtaggcttcccatctaagacacattcccaactcccagcccagaacccttctgtgccagccattccaggctggtctgggggtagggtatccccagaacaactctgcttgcagtgagtaattcctcaatttccagttaggtccaatctgaaaggtattgccagtcctctctggggtccctcagctccctaccacccctctacacccaccctgagttctccaactctgactgaactcttgaaaagaggccagggtcaggaatgatggggaagaagcagagtgaactgtcaccttcaactcctcaccttatccgccgtccatgactcctgtgtatcctcaccctccccagtgttatgcccctcatccagctttctgtgttgtgtctcagcatgtgtgtcccctctttcccatcacaactgatacttcagtcatccttgcctcttgcctctgctgttcaccattctcaacctcccaccctcaaccttataagcccc

SEQ ID NO: 350968 - DNA, 1466 bp, Homo sapiens
  misc_feature (1)..(1): n is a, c, g, or t
  misc_feature (5)..(6): n is a, c, g, or t
ngcanngaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtaccctttgtctcggcagcctgacggccccgccgggctctccggagaggggaacgggcggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcagaagttagtggtcattctttcctgtagatagtttatctcatgtaaagacccacccagcttggtttaaatttttttctcactgacgtataaccatcagctttgatacttccattttcaggctcagactttgaatttaaggaaactaaagatgactttattttcttttctcttggttttttttttccaaaaacaaaaaataaatccattacatgttaacatagatgataagagtgacatcttgcatttttgcaaatctttttaatgcctggtttaatagaagattctcagatctacgtcagactgttgtggttagcacaccatgtaacctctggaacactccactgtacactcatactttttt

SEQ ID NO: 350969 - DNA, 1107 bp, Homo sapiens
  misc_feature (1)..(1): n is a, c, g, or t
  misc_feature (5)..(6): n is a, c, g, or t
ngcanngaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtaccctttgtctcggcagcctgacggccccgccgggctctccggagaggggaacgggcggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcaga

SEQ ID NO: 350970 - DNA, 851 bp, Homo sapiens
  misc_feature (1)..(1): n is a, c, g, or t
  misc_feature (5)..(6): n is a, c, g, or t
ngcanngaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtacccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcaga

SEQ ID NO: 350971 - DNA, 763 bp, Homo sapiens
  misc_feature (1)..(1): n is a, c, g, or t
  misc_feature (5)..(6): n is a, c, g, or t
ngcanngaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtgtctgctgcctgatgtgcatgctgtgatgtgttactagctggtggcgacgtaggatgtgttttgtgcatgtagtgtgccgtgtgaggagaagcatggaaggtgcatgtgctggctgtgcttgtgtgcccttctgtgcccttcctttgtgtctgccagcgtgagatataccctatggatcatctgtgtcatggcctttgatctggtgccccctgccctggggggtctttcttctctgtggatggatgggtgggacaacggtgtgctgtgcggaggtgggattgtgcttggggtgtacgcttgtgtagctggcccttgattgcctttgctgtgtggccctgattgatggtgctgccgtccgggtgatctgctgagctgtggcatcgtggtgccgtgtggacccagagaaccagggggttttaaagttgcgaaagagaacagccgctttgtggcccaagtacgcccagctgcggtgtgtggccccaccggacaaagacaggaatccaatgcccatttgcggcccggg

SEQ ID NO: 350972 - DNA, 937 bp, Homo sapiens
tccagagctagttggtcggaggataataaaccactatccctgactttttctgtgatccttgcgaatatcttgcagatttgtttggagtacctctctcttctgaagcctgtaaccttacctatttgtaaaataaatttaagttctcctgctctctggtatctcaacatagggggagaaaagacccaatttaagtaacttttatagatctaaatttcgaaggaggatcctttcttattcaaaaccgaactaaaactaagtgacttgattcacagaaatcttaatattgagatgtctaaattgggtgggtttcagcacgtaaatgttgacaactaatagacattttaccatcgctgtggctttaccttgttgtggaagttgggttcggacaccaggataatagaatcttcctctcatttcccccagatccttgacagtataacttgatgacttctaatcctaaggaattgcataccttggttttcaggtacagccatttaaacagggtgcagtgtattgacagttcaaggaagtccaggagtcgcgtggatttgtgtgctacaattttgttgtggaaaattgtactgtaatacttctcttggtactgtaagaatttttaatgtagaaattatgctctgtaatgttgtttttggaaataaaactgtttaaactctttgggttgtttaaccttttaaagtgaaatagctgtgacagtgaaatgttacttttgagagtagtgtcttaaatctaactttacagataagccaagtgtatgtagtagctcagattgtctagttgggcactgactttcagcacattgtctcatgagacactacctcttaatttattttacttgtatcaactttagagtagcatggccatttgtttattttttaataagtgatttgtttttaaaaattaaagtacttgtgactgcaaa

SEQ ID NO: 350973 - DNA, 3883 bp, Homo sapiens
atcgcaaagttgttaaccccagagtcttctggctgtgctgcctcctctgcttttaatcttctgtggatatttctccgatttcccccaaaagcccacagatcctgggggaagccaccccattcggccaccgatcatggaagaaagtattactttttatttaccaaacattttaaagatgttggaagatccatatgctgcctggaggctgttgtttctagggacacaagtatccagcctatattgttacaattttttttcaagaactgccgtcttctttgcctgcactaatggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350974 - DNA, 1027 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaaatgtcgagggtgcagcgtgtttgcccggacgacttacttttctagaagatccttgacagtataacttgatgacttctaatcctaaggaattgcataccttggttttcaggtacagccatttaaacagggtgcagtgtattgacagttcaaggaagtccaggagtcgcgtggatttgtgtgctacaattttgttgtggaaaattgtactgtaatacttctcttggtactgtaagaatttttaatgtagaaattatgctctgtaatgttgtttttggaaataaaactgtttaaactctttgggttgtttaaccttttaaagtgaaatagctgtgacagtgaaatgttacttttgagagtagtgtcttaaatctaactttacagataagccaagtgtatgtagtagctcagattgtctagttgggcactgactttcagcacattgtctcatgagacactacctcttaatttattttacttgtatcaactttagagtagcatggccatttgtttattttttaataagtgatttgtttttaaaaattaaagtacttgtgactgcaaa

SEQ ID NO: 350975 - DNA, 750 bp, Homo sapiens
gcttctaacacttcaactttaaagaccactcccttagcttttggtaaagtagttgaataatctacaaaataggacttaaatattatagaaaaaaatcttaaaggccttctccttttatattataaaaattgcctatgtgatgatttttgagctataaaaatggcacttcacatggttcaaccaaataagttttaatgatcgctttatgttcttaataggcttctagtgtatttgcttttaggagtggttggagggtgtcgcatccattgtcttttattacttatatgtatattcatagtaaagataatctcctttctttaactttaaatgtgtaagacaaatctaagcttagattgtttgcgactctgaaaacaaaatccaagaattctttcttatttctttagaaagtctaggtcttgtttttatgcagacatctgtggagtttttgtcggtgaattcacacagtaaatgattgcatatggttccttctgtcagcttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcaggtacaacttcatttgtatataacaagtatatacatattctatgtaaagaactgtattgtatggaaagagtgtgagattgcaggttggaggttatagggatcctcagagt

SEQ ID NO: 350976 - DNA, 625 bp, Homo sapiens
atcgcaaagttgttaaccccagagtcttctggctgtgctgcctcctctgcttttaatcttctgtggatatttctccgatttcccccaaaagcccacagatcctgggggaagccaccccattcggccaccgatcatggaagaaagtattactttttatttaccaaacattttaaagatgttggaagatccatatgctgcctggaggctgttgtttctagggacacaagtatccagcctatattgttacaattttttttcaagaactgccgtcttctttgcctgcactaatggtaagtttgtaattttcaccatttatgtcagtctttgaaagagccaccggctaaaaaggattttcattgtgtttcttctaacaaaaccaatctttgtatttttctttagctttgatctctgcacgttctacctaatcttgcctggttaatttttaccaaaagaaaaaaaaatagttttttttttcattgttaaagctaaatgtttataatataaattatactttaattactgtgaactacagaggaactcagatatttcaagatggacttgttttgtgccagtaatgttggcaatgccaaatatgtgcatatcctctttataaaaattatgtctt

SEQ ID NO: 350977 - DNA, 4124 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350978 - DNA, 3928 bp, Homo sapiens
gcttctaacacttcaactttaaagaccactcccttagcttttggtaaagtagttgaataatctacaaaataggacttaaatattatagaaaaaaatcttaaaggccttctccttttatattataaaaattgcctatgtgatgatttttgagctataaaaatggcacttcacatggttcaaccaaataagttttaatgatcgctttatgttcttaataggcttctagtgtatttgcttttaggagtggttggagggtgtcgcatccattgtcttttattacttatatgtatattcatagtaaagataatctcctttctttaactttaaatgtgtaagacaaatctaagcttagattgtttgcgactctgaaaacaaaatccaagaattctttcttatttctttagaaagtctaggtcttgtttttatgcagacatctgtggagtttttgtcggtgaattcacacagtaaatgattgcatatggttccttctgtcagcttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350979 - DNA, 3974 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350980 - DNA, 3873 bp, Homo sapiens
  misc_feature (1438)..(1438): n is a, c, g, or t
  misc_feature (1443)..(1443): n is a, c, g, or t
  misc_feature (1449)..(1449): n is a, c, g, or t
  misc_feature (1476)..(1476): n is a, c, g, or t
  misc_feature (1487)..(1487): n is a, c, g, or t
  misc_feature (1508)..(1508): n is a, c, g, or t
  misc_feature (1535)..(1535): n is a, c, g, or t
  misc_feature (1539)..(1539): n is a, c, g, or t
  misc_feature (1570)..(1570): n is a, c, g, or t
  misc_feature (1574)..(1574): n is a, c, g, or t
  misc_feature (1577)..(1578): n is a, c, g, or t
  misc_feature (1580)..(1581): n is a, c, g, or t
  misc_feature (1589)..(1589): n is a, c, g, or t
  misc_feature (1592)..(1592): n is a, c, g, or t
  misc_feature (1598)..(1598): n is a, c, g, or t
  misc_feature (1602)..(1603): n is a, c, g, or t
  misc_feature (1610)..(1611): n is a, c, g, or t
  misc_feature (1613)..(1613): n is a, c, g, or t
  misc_feature (1616)..(1616): n is a, c, g, or t
  misc_feature (1623)..(1623): n is a, c, g, or t
  misc_feature (1633)..(1633): n is a, c, g, or t
  misc_feature (1663)..(1663): n is a, c, g, or t
  misc_feature (1665)..(1665): n is a, c, g, or t
  misc_feature (1675)..(1675): n is a, c, g, or t
  misc_feature (1681)..(1681): n is a, c, g, or t
  misc_feature (1688)..(1688): n is a, c, g, or t
  misc_feature (1701)..(1701): n is a, c, g, or t
ctgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacatgtgttggtaggatgtcatttagctggcaccatctttttgcctctttctttctcctttgctgcagaacctttgtgtaaatgaagacgtgaaaagcctaggttctgtgcagcttatcaacgaccgctgcgtggacatgcagagaagcaggcacggtagccactgggaccgtggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccccaccccacggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcacacaacctgatcgacaccatcacgggcatgcacagcgtggaggtcagcggctcccagctctgccaggcccattcccagctgctgcagtacgtggagcgatacggcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggctgggtgnggtgnctcacncctgtaatcccagcacttgggaggccnaggcaggtggntcacctgaggtcaggagtttnagaccagcctggccaacatggtgaaancccntctctactaaaaatacaaaaattagctgggngtgntgnngnngcctgtantcncagctnctcnngaggctnngncangagaatngcttgaaccngggaggcggaggttgcagtgagccgagatngngccactgcantccagnctgggcnacagagtgagacngtctcaaaaaaaaaaaaaaaaaaaaaaggccacagcatcgagtcggccttgttggcctactgggtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350981 - DNA, 3850 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350982 - DNA, 1642 bp, Homo sapiens
ttctttgtttttaacatctaggttgcttgagtactactataattttgatggtaatgtagttgactgtggaatttatttatagtcaacattagcctgatttctgataataaactataaagattcgtattcctctacttgctagcttgttcccaaagagtccaatttcttcctgttaataaaaataaactttttgttgggaagataatgttcatttgctgaatatttatgttgtagataagtaattgattgaactttatttcaacagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350983 - DNA, 1152 bp, Homo sapiens
  misc_feature (258)..(258): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (312)..(313): n is a, c, g, or t
tggttctggcaagcccatgtgtgttagagcttccaaacctcccccttgctacatctccccttgcatctcacacccgagcgctccatctaccatccttctctctccctattccttacctgccttacgtcctcgtacccaaagaatttccccctagagtagccccttccaaatttattcctaggtttccatccttatccctcccccccccccatcttaagttgtggtttttccccaccaaggacaacccccgggaagaantttggggnttntngggggcccccctacacccccttttttattattgaagacaannccgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350984 - DNA, 2658 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttggtatgttgactgttaatgatgtacgtttctatagaaatgtcaggtccaaccatttcccatttgttcgactatgtggtctgttacatttatggcttaaagtccttttctcttaaacagttaaaaaaaaaatcttggtctaagtatttatttgaatcctgttgctataggagtttgtatgtgtgtgtcttcatttaaacatacctgcatacaaagatggtttatttctatttaatatgtgacatttgtttcctggatatagtccgtgaaccacaagatttatcatatttttcaataatatgagaagaaaatgggccgtaaattgttaaccattttatgttcagatatttctctagtttttacctagtttgctttaacatagagaccagcaagtgaatatatatgcataaccttatatgttgacacaataattcagaataatttgttaaagataaactaatttttcagagaagaacatttaaagggttaatatttttgaaacgttttcagataatatctatttgattattgtggcttctatttgaaatgtgtctaaaataaatgctgtttatttaaaatattcctataatcttagctgtctgttttaa

SEQ ID NO: 350985 - DNA, 449 bp, Homo sapiens
cctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaactaatgtgtagtggtcttttgcttttgttttcaacccaa

SEQ ID NO: 350986 - DNA, 915 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggtacagccatttaaacagggtgcagtgtattgacagttcaaggaagtccaggagtcgcgtggatttgtgtgctacaattttgttgtggaaaattgtactgtaatacttctcttggtactgtaagaatttttaatgtagaaattatgctctgtaatgttgtttttggaaataaaactgtttaaactctttgggttgtttaaccttttaaagtgaaatagctgtgacagtgaaatgttacttttgagagtagtgtcttaaatctaactttacagataagccaagtgtatgtagtagctcagattgtctagttgggcactgactttcagcacattgtctcatgagacactacctcttaatttattttacttgtatcaactttagagtagcatggccatttgtttattttttaataagtgatttgtttttaaaaattaaagtacttgtgactgcaaa

SEQ ID NO: 350987 - DNA, 976 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcgatccttgacagtataacttgatgacttctaatcctaaggaattgcataccttggttttcaggtacagccatttaaacagggtgcagtgtattgacagttcaaggaagtccaggagtcgcgtggatttgtgtgctacaattttgttgtggaaaattgtactgtaatacttctcttggtactgtaagaatttttaatgtagaaattatgctctgtaatgttgtttttggaaataaaactgtttaaactctttgggttgtttaaccttttaaagtgaaatagctgtgacagtgaaatgttacttttgagagtagtgtcttaaatctaactttacagataagccaagtgtatgtagtagctcagattgtctagttgggcactgactttcagcacattgtctcatgagacactacctcttaatttattttacttgtatcaactttagagtagcatggccatttgtttattttttaataagtgatttgtttttaaaaattaaagtacttgtgactgcaaa

SEQ ID NO: 350988 - DNA, 870 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggtacgtgttaactcccctgtccgacccaccgtcaggcccgctccctctgctgcctgcggcggcggcggagcagcaaacccacacaaaatggccgccatcttctcttcgccgccgactctcagtcgccggccgggcctataccccgcctcccccagcctcgacccccggccgccgcggcccagcggggccccttctaaggccacccgctgaccctggccacttgtacccgggtcccgcggagttcgggggcccgaaaggcacaaaggggtcacgtgacgaagctgccggcagccattttgtgtcttagttcttgggttgggccttgtgcatccggagaggggaacgggctgggtggctgtgggggtgcggcgagtcgggagccgtggaggacccgcctacaggcctctc

SEQ ID NO: 350989 - DNA, 4182 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaacaaaaaaaacacaaagggagaccgaagggacaagacacacaaatacgacacagggccaa

SEQ ID NO: 350990 - DNA, 3658 bp, Homo sapiens
ctgactcttgaggatccacgtacagttcggcagatgcccaccgtaatgcagaaggaagaggagtcgaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactacagagttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaac

SEQ ID NO: 350991 - DNA, 3081 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgctgcccacaggcacgttcataaatggcttgcggaacaatgaaatgagacttgcgttggggttcataagtgacaagcacttccatgtagcatttatc

SEQ ID NO: 350992 - DNA, 2992 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtgtaacacgacagcccagtgagaaccggacatcacggttaaagctgtatgctgagtgtaacacgacggcacagtgaa

SEQ ID NO: 350993 - DNA, 1536 bp, Homo sapiens
agcggggcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtaatgtatattttaataatgttagaggaagtatagtgccattaacattttgtatattgagttaatttatttcctatgcaataatctaattacagaaatatctttttttaataatagagactttaaatatgtggtatgatactttttatacttttacatgttttcctctattttctttaaaagtgactggattcacttaagttaaaacataccaagtatttccatttcaaagtggtcttttttggtccttgagttgcatgtaggacttgagttaattgatagtactgcttcttttttaatgcatataaaatttaaaacactggattgttaaatagaaaagggtaaagaaagagggagaaaggcccatatatcttaccactcaagcatttggcaaggtacacaatgaaaactt

SEQ ID NO: 350994 - DNA, 1795 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 350995 - DNA, 2677 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcaaaaaaaaaaaaaaaaaaaaaaaaaaaaaaaaaaaaacttttggggcacgcgccagcgcgacgccaccgaagaagaatctttctagagacaacaccaatcgacgtagaggagcggcgcggcgaggcccccaatggggtgacaggtgacaaactgcgtggtccgaacgcaactgacgtgtcccacgtgcgagaaaaccgcgctgggacgaagcacagaacgaggcgaggggccatctccacaccagaaatacaaagaacaccgccgcggcgggcacaccacacgcggggcaggcccgaggaacaagaacaccccacagagcagggagcccccggcgagagaatcaaaacgagcggaacacataacaaaaggaggggacacccaaagacaacagctggccgaaaaacataaaaacgatgatgggcgcccaaacggcagagggagaaccaccagcaacaagcacgagaacacacatatccagacgactttgcctcgaacacataatcggcacacaaaggaactaacgacgagtctagaacgccaccgtgtacggctatacagccactcaactatcacttagagacacccgaacccaaaaaatcatgaaaatcactcaactactgcagacgatttaatgacacagagatgaagtgctctagcaaatataaggagagcgcaaagcggaggcagagaaaggaagcggcgggacagcagcggcagaagagcgcggagcggggcgcgcgacaagcgacgagctgggacgaggcaggaatagcagccatcaggagagcgcgggacaagtggctgagagacagcacacgcgggacaaaagcgacggaagggggagcgcgacggaggaggggcccggacaggagagggaagccc

SEQ ID NO: 350996 - DNA, 1488 bp, Homo sapiens
gagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 350997 - DNA, 1753 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 350998 - DNA, 1618 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaatcgttgttaggattcaatgggttaatatatgtaaaatgctagaatagtgcatgccgcatagtatgcaatacatgaatgttagctatagtcattatgactaatgtccctccccttgcccaagagtttgctaggtctggttaccaaacctttctttgtactcttgccatgtgatagtatccaatcaatggtaagaacagatccg

SEQ ID NO: 350999 - DNA, 1210 bp, Homo sapiens
gtgctgtggggatatcaggccgggatgcttctggtgacccactgatgtgtgctgtcgagcgggcaggggcatgctgtgagctatctcctgggccgtggggctgcctgggtgggggtctgtgagctgagtggcagggatgcggctcagctcgctgaagaagctggcttccctgaggtagcccgcatggtcagggagagccatggaggagagaaggagggaggagaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351000 - DNA, 1140 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagaacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351001 - DNA, 618 bp, Homo sapiens
aaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgac

SEQ ID NO: 351002 - DNA, 1910 bp, Homo sapiens
acgagggtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351003 - DNA, 1564 bp, Homo sapiens
cttaggctctaagtgtgaccttcgaaccctggtcagagtaatgaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351004 - DNA, 1699 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351005 - DNA, 1440 bp, Homo sapiens
gagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccaagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattca

SEQ ID NO: 351006 - DNA, 1402 bp, Homo sapiens
ggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccaccctcggccactctcccagcccgcccatggtgaggaaccgcacctgggaaaggccaggcctcgcaggctgctgccggggttgcctcttgcctcattgcctatctttagagtgtccaagatccgggcagactgacgtgaagccccaggtatttactcaacaa

SEQ ID NO: 351007 - DNA, 1691 bp, Homo sapiens
gcgtgagccactacacctggcctcagtcagatataaaaattaaaaactcagattgggatctgaaagacttgtaagtgcaacaataatttattcagcatacatatcctccagctctcccccgctaatcctccccaactttgcaaagaaaaaggaactaaagcagcactaaaaagtagaaagaactcacagggtcttacattctcctgttttctggaactcttgtttgaaaggtgatacttcctcttgcctcccacctcagatacttacagaccaataacctaaaacctaagtggagactgttgggctaaccagaggtgagctcagtcttcttaaatctgtgactctgttccagatcaacccttagtgaaatctgaataattatttcctcactttaatcagacgaaatgggagctctcactctctaggaaaagcattaatgttcttcagtcaccactgttcttccataatacaaacatacagagcaaccaaaaaagagagtgacacccacaattaaatttttaaaatcagcaaaaaccaacctatagatgattcagatattggaactggagacagactttaactgtcatgttcatagggcttatgggaaaatagttgaaacagtggttgaataaggaatctcagcagagaaatggaagcttaaaaaaaccaatggaaaggccgggcacagtggctcacgcctgtaatgccagcactttgggaggccaaggcgggcggatcacgaggtcaggagttcaagaccagcctggccaacatggtgaaaccccatctctactaaaaatactaaaattagccggcatggtggcgcgcccctgtagtcccagctactcgggaggttgaggcaggagaaccacttgaacccaggaggcagaggttgtggtgagccgagatcacaccactgcactccagcctgggaaacagagcgagactccatctcaaaaaaaaaaacaaaaacgcaagtcgttatctgtatttgaagtttaaatctagtacgtgaaataaaaaacaaaataggcttaacagcagagtgaatactacaaaagaacagtgaactcgaagacgtatcaatagaaattatctaaaatgaaggtcagagagatggaaaaaaaatggatagagcatttctacgatctatgcaacaatatcaggcagtccaatatatgtgtaatcagagtcctagaagggtaggagacagaatgggtaggataaattcacaaaagaagtgcaaaacttatacaatgaatactataaaacattgttgaaattaatgacaacctaaataaatgaaaatacatcccatattcatggatcagaagactcaacattttgttaaaatggaatactcttagctagtaaattgtagaaccagtactgaaaccaaggtctgttcaaattaatttaatcattcatataggaattcatggtgagtaggacaggcaaaggtggctgtgttcatggagcctccattagatggagggagtcattctttaataaaacggtataatttcagatagtgttaagtactgtgaaataaagcatgatgtgataataattggggaagatggtttaggttagatggtcaggaaatgcctctctgaaaaagtctcataaatgtctctttttctttttacattttgttttcttgaattaggaccaaataaaggccacacatt

SEQ ID NO: 351008 - DNA, 2062 bp, Homo sapiens
gcgtgagccactacacctggcctcagtcagatataaaaattaaaaactcagattgggatctgaaagacttgtaagtgcaacaataatttattcagcatacatatcctccagctctcccccgctaatcctccccaactttgcaaagaaaaaggaactaaagcagcactaaaaagtagaaagaactcacagggtcttacattctcctgttttctggaactcttgtttgaaaggtgatacttcctcttgcctcccacctcagatacttacagaccaataacctaaaacctaagtggagactgttgggctaaccagaggtgagctcagtcttcttaaatctgtgactctgttccagatcaacccttagtgaaatctgaataattatttcctcactttaatcagacgaaatgggagctctcactctctaggaaaagcattaatgttcttcagtcaccactgttcttccataatacaaacatacagagcaaccaaaaaagagagtgacacccacaattaaatttttaaaatcagcaaaaaccaacctatagatgattcagatattggaactggagacagactttaactgtcatgttcatagggcttatgggaaaatagttgaaacagtggttgaataaggaatctcagcagagaaatggaagcttaaaaaaaccaatggaaaggccgggcacagtggctcacgcctgtaatgccagcactttgggaggccaaggcgggcggatcacgaggtcaggagttcaagaccagcctggccaacatggtgaaaccccatctctactaaaaatactaaaattagccggcatggtggcgcgcccctgtagtcccagctactcgggaggttgaggcaggagaaccacttgaacccaggaggcagaggttgtggtgagccgagatcacaccactgcactccagcctgggaaacagagcgagactccatctcaaaaaaaaaaacaaaaacgcaagtcgttatctgtatttgaagtttaaatctagtacgtgaaataaaaaacaaaataggcttaacagcagagtgaatactacaaaagaacagtgaactcgaagacgtatcaatagaaattatctaaaatgaaggtcagagagatggaaaaaaaatggatagagcatttctacgatctatgcaacaatatcaggcagtccaatatatgtgtaatcagagtcctagaagggtaggagacagaatgggtaggataaattcacaaaagaagtgcaaaacttatacaatgaatactataaaacattgttgaaattaatgacaacctaaataaatgaaaatacatcccatattcatggatcagaagactcaacattttgttaaaatggaatactcttagctagtaaattgtagaaccagtactgaaaccaaggtctgttcaaattaatttaatcattcatataggaattcatggtgagtaggacaggcaaaggtggctgtgttcatggagcctccattagatggagggagtcattctttaataaaacggtataatttcagatagtgttaagtactgtgaaataaagcatgatgtgataataattggggaagatggtttaggttagatggtcaggaaatgcctctctgaaaaagtctcataaatgtctctttttctttttacattttgttttcttgaattaggaccaaataaaggccacacattgagattgcttgctatgtctcttaagtctctttatgtataggttcctctttcatatctcgcttttgaatttttcctggtaattcagttgttgaacaaagctggtcatttgtcctgtggcgtttcccatgatctggtttctgactgcacagcttccaagtgaatgccatctgttgcgggaagtcagggaccccaaatggagggacctgctgaagccgtgacagaagaacataaattgtgaagatttcatggacatttattagttccccaaattaatacttttgtaatttcttacgcctgtctttactacaatctctgaacataaatcgtgaaaatgtcatggacgtttatcacttccctgatcagtactcttg

SEQ ID NO: 351009 - DNA, 256 bp, Homo sapiens
tgatctgcctgcctcggcctcccaaagtgctgggattacaggcgtgagccactacacctggcctcagtcagatataaaaattaaaaactcagattgggatctgaaagacttgtaagtgcaacaataatttattcagcatacatatcctccagctctcccccgctaatcctccccaactttgcaaagaaaaaggaactaaagcagcactaaaaagtagaaagaactcacagggtcttacattctcctgttttctgga

SEQ ID NO: 351010 - DNA, 187 bp, Homo sapiens
ttttttttttggttacatatttcagtttattatcaaagaaaacaatagtctttttcctgagcgagatgttagaatgtgtatttaactgaaattcaaaaaaaggatgaactggaatcatttaaaatgtatcagtatgtctaatatataagtaaatgtcgacgcggccgcgaatttagtagtagtagag

SEQ ID NO: 351011 - DNA, 155 bp, Homo sapiens
ggcccaagttggtctcagctaaacgaacatgcccccactcaaattctaccatgactttcactgtgagtagagatgaggcagttggtttggctgagggacgtttgtgatgggtgaaatgggaggtgagctgagacccttctggagtgaaggaggaa

SEQ ID NO: 351012 - DNA, 7565 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagaggtaccaaacatgcccctgatgatagaaaaatgggagagtcttgaggtcctgtttggtgtggcttgggatttcttcggtttcctctaagtccattctagggataaaagaagagggagatgtttggggtcctgagtttcttctgatggattcagggctcacactccttgcctgcctttcttagcaccctgtggatgacattgacaagatgaaagagcgagctgccatgaacaactccttcatctacataaagattccacaggttccactgtgtgtcagctacaaggtctgcacctctcaagcactttgtagaacagggtgggaagggaaccagataagatcagagattctatacagggagacagctaggttgtttgtgatgctgagctgtgggtgataaatctgctgttccctctgctcccctcaagagtcagcatcattacgaggctgaggtaaggggaaatcagtatctgtaggttactattgtaggacttggcactcaagtggctggctgggactcaaaatggcagctgatgtattccccacccctctttttttctttcccctccccctcctcttacagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351013 - DNA, 6976 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351014 - DNA, 7345 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaaggttcatgggtcggggtactggtactgagcgagaatgggaggactagatactctctttgctcatgccccatatggtctccttaatctaatctcagtgtaactggggagtggaaggagggaacatactgagagaaaatagccccagctcacaagttttgatgacagtctgttgatccctttgccggcttctgaccctctcccagttttacctcttgcccttccagtgctctcctctgatctgtcctctggcctcttacagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351015 - DNA, 7133 bp, Homo sapiens
  misc_feature (24)..(24): n is a, c, g, or t
  misc_feature (7109)..(7109): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaataggattaaaaaaataaaaaattcttccggtatgggctcgaaggaactttggcntctcttatctacttctttccttaa

SEQ ID NO: 351016 - DNA, 7064 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagagaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351017 - DNA, 7028 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagaggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351018 - DNA, 5628 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtatctggggtatatggtcacacaaaggcagctgtattgagagacattgacctagct

SEQ ID NO: 351019 - DNA, 5564 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggattaggcattctaaggatcaagctttctaaggatcaagctcagtggtgtagggaaggcaccatggccagagtctggctctcagtggtggcttttcaggggtagcggggctttgtcagaaggaatctctgataaacattgggctactcctgggtccaggaacat

SEQ ID NO: 351020 - DNA, 5090 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaagagcggtggataccttagtcttatagagcgcatgtgaatgtgtacataaatagaaaaactatggtacagttgatggtggataagcgtgaaggatgcactac

SEQ ID NO: 351021 - DNA, 4625 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtaagctcggggagatgagactttttgggtttgggtttagaacatggatatgggcttggacaggagttttaaaaggactgagtcatggtgcttctatctaggtaaagaagtgaaactattatttttccttcttaggccacctaagtcttacatattaagtaacagtgatgttggggcattaaatggtctggtcctatggccagaagagaatcagaaggggagtgttggagccaaaacaagatgagtaagggaaagaagcaaagtggtaaatgccataagagag

SEQ ID NO: 351022 - DNA, 848 bp, Homo sapiens
gcgggctgttcagaggtcccctctggatgcaagtgtcagtcttaagtttcagcaacaccagggaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggtaagcactggggagcagaggatctagccgtcctattcttgcctcagagttgcttcagggcctccttatcaaggtgttaagttctcattctgtgcagttggaggagatgctaagattagacatttccaattgccttgtcccttctagccaccagagcttgactggaggtaagtggtgaggaaagggaccaagttctcttttttttaaattttttttttgagacagagtcttgctctgttgcctaggctggagtgcagtggtgcggtcttggctcactgcaagctccgcctcctgggttcagaccattctcctgcctcagctacttgggaggctgaggcaggaggattgcttgagccctggagttcgagcctgcagtgagctgtgatcacaccactgcactccagcctgggcaacagagtgagaccctgtctctaaaaaagaaaataaataattaaaaaca

SEQ ID NO: 351023 - DNA, 632 bp, Homo sapiens
ctgaagttcttgagaaccaggaaaaggaagatctcctaaagaagcaggaaggtattcagggcttgaaaggcttttaggaagggactagagaaattgtgaaagtagttatttccttggtggttttgagacagtagagttattaaaaatccactgtgcactggcattaacatttcactttgctctactttttgtaagttctgctatgagaaaataacctctattcttggagggagctgggatgaatgggcattgtttatgattctgaagtaaacatgtttctgcccatgagcaactctcaccctttctgtggggttgactagtggggtggttccaaatgtgggttaagagatggagtagatatttaggtagaaacttgagccttttatttagctgctaacaattatctaggggctgtggataccttcacccttatccaccatgagctggaaatttccaccaacccagctcagtatgccatgatcctggacattgtcaacaacctgctgctccatgtagaacctaagcggaaggtgagcatgggcccttgtagaatgctggttagcctcacaggaacacccagactttgtgctttatttgggcttctgtaacaaaagccatgcttcacactgaaa

SEQ ID NO: 351024 - DNA, 7087 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351025 - DNA, 7503 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtatcccgccagggctcatggctgtttggctaatggggctggcaggcagatcctcttttcaggagcctttcattttagaatccatgaataaatatccttgggaaggggcaggtgcatgaagtgagtggcttctatgcctaccctctccatgacctcactcagattattaaattcagtgtttactgagtgtttcgtatagcaccattgattttagggaactgagagctaacacaacctaaagtttagaaggggttataattagactgtaagcttcttgaaagcagagaccattgtatgtgaattgccccattgtgccttggatgtgtttaataaatctttattgtcttggtcattttgatttattctgcctgcccactaatatttacattttcttttactcctctccaatctgccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351026 - DNA, 7666 bp, Homo sapiens
gcgggctgttcagaggtcccctctggatgcaagtgtcagtcttaagtttcagcaacaccagggaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggtaagtatgccatgatcattcagatgcctcatttcctcctgggcgtaaagtgtgaaggagcttagggcttacatcctaggttctttgaccttagggggttccctcaagtcagtacccagtgttccagatcaccacattttgacctaaaacttccaaactttcttacatacaccttagaggcttatcatccccacaggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaaggttcatgggtcggggtactggtactgagcgagaatgggaggactagatactctctttgctcatgccccatatggtctccttaatctaatctcagtgtaactggggagtggaaggagggaacatactgagagaaaatagccccagctcacaagttttgatgacagtctgttgatccctttgccggcttctgaccctctcccagttttacctcttgcccttccagtgctctcctctgatctgtcctctggcctcttacagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351027 - DNA, 6809 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatata

SEQ ID NO: 351028 - DNA, 6965 bp, Homo sapiens
  misc_feature (24)..(24): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351029 - DNA, 6161 bp, Homo sapiens
  misc_feature (24)..(24): n is a, c, g, or t
  misc_feature (6143)..(6143): n is a, c, g, or t
ggctggcgtctagaggatccctcnaaacgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagtcccnggcccagtgtggagagag

SEQ ID NO: 351030 - DNA, 1435 bp, Homo sapiens
gactctatgtaggatcccctgccatgtactccatggtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcaaatttgt

SEQ ID NO: 351031 - DNA, 1294 bp, Homo sapiens
tctccctctttctctgctcttcttccttggagatggcagaatccagccccttagggaaatgaatcataggtgaaggagtaaggagttgagggagacagagttagtggaactactgaaacaacctgtccaattaatttggacctccagaataggctctgagaagaagccacaactatcttccaactagactgaatccctgaggtcttgtctcctcatgttatctgctcctgaaggggtttggaaatctccagggtttttcaggtttgtggagaaagactaggacaaccactgaccagcaactgccctggcacttggtagggctatgatggatttactgaacgttgaagcagaaagtgaaatgcaaaccaattttagtattgcatgccctatgttaatctctggtcagcactgagtgttcaaagacagtaggacgtcggttgctgacctgcctcttagaagctagtttaactcagcgggtaaggatctaggacttctacattagttaccactgtaatgataacaccaccagaaaagtctgtagtttaatatttcccaccttatgcctgtttcttcattcacgcaaagaaaataaaaatataatacctaagcctctttgtattacataaagcaaaatgcaaagcactgtatcttccaaatacttcctcttgatatggtggaattatagagtagtatcatttgtaactgaaatgtcttctagggttgctatgcgaaagcaagactgtggtttcattccaatttcctgtatatcggaatcatcaccatctgtgtatgtgtgattgagggtaagagcttaaccacagggttattgtgaggattacatgagttaagtcaggtaagatttcagaataataccaggtacacagtatttacacaataaatgttagctatttttactaatatatgaattcccccagccaagtagcaaataatgtaattaacaatttgctttaaggtatatagaaaatgtgctataagaacatctcttggccgggcgtggtggctcacgcctgtaatcccagcactttgggaggctgaggcaggcagatcacgaggtcaggagatcaagaccatcctggctaacatggtgaaaccccgtctctactaaaaatacaaaaaattaaccagacgtagtggcaggtgcctgtagtcccagctacttgggaggctaaggtaggagaatggcgtgaacctgggaggcggagcttgtagtgagtcaagatcgtgccactgcactcctgcctgggcgacagagcgagactctgtctccagaaaa

SEQ ID NO: 351032 - DNA, 1555 bp, Homo sapiens
tgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351033 - DNA, 1386 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttgtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351034 - DNA, 1602 bp, Homo sapiens
tctccctctttctctgctcttcttccttggagatggcagaatccagccccttagggaaatgaatcataggtgaaggagtaaggagttgagggagacagagttagtggaactactgaaacaacctgtccaattaatttggacctccagaataggctctgagaagaagccacaactatcttccaactagactgaatccctgaggtcttgtctcctcatgttatctgctcctgaaggggtttggaaatctccagggtttttcaggtttgtggagaaagactaggacaaccactgaccagcaactgccctggcacttggtagggctatgatggatttactgaacgttgaagcagaaagtgaaatgcaaaccaattttagtattgcatgccctatgttaatctctggtcagcactgagtgttcaaagacagtaggacgtcggttgctgacctgcctcttagaagctagtttaactcagcgggtaaggatctaggacttctacattagttaccactgtaatgataacaccaccagaaaagtctgtagtttaatatttcccaccttatgcctgtttcttcattcacgcaaagaaaataaaaatataatacctaagcctctttgtattacataaagcaaaatgcaaagcactgtatcttccaaatacttcctcttgatatggtggaattatagagtagtatcatttgtaactgaaatgtcttctagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351035 - DNA, 1478 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351036 - DNA, 1219 bp, Homo sapiens
tgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351037 - DNA, 1496 bp, Homo sapiens
agatatgagtgattcacatgattcacagtcaaacaaaaaagccaccaagcagaatcccactgtgatccctcctcagctggtctgaaaaatacgaattgataaagtatttcatttgaaaacctgatcttgcatgttaaggggctgatgacgaaaattgtaatcaatttcctctttgtttctgtgcttagtttgacaagtgatgggtgaattgagggtagttttttgtcctttttaataaaaaaggacaaaaataatgtgatatttctaacatttttctacccaagtgttgggtatatcatagattagttaaaactcaatcaggaagctcagagaaaatgatttttctctgtttggaaacaaaggaggcacagagcatggatagagataactcattgcacagtgttcagtgagcagaatatgaccatcctagcagcaaggcttctgtgacttcctcagaagataaaacatgctccagtactttacagcctgttatcttgtcatcattgaccccgtttctctcctcactgctattctttaaccaaaggaaagagctcctgagagagacttgaaagtaatggttggaagggtggtttcagtgtaatggatacattctttttctcagaggccaatcccaggcattgtgaaagaaatggcttttcttatgaagacttcaaattttcccaactcttttcacaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351038 - DNA, 1243 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgagggtaagagcttaaccacagggttattgtgaggattacatgagttaagtcaggtaagatttcagaataataccaggtacacagtatttacacaataaatgttagctatttttactaatatatgaattcccccagccaagtagcaaataatgtaattaacaatttgctttaaggtatatagaaaatgtgctataagaacatctcttggccgggcgtggtggctcacgcctgtaatcccagcactttgggaggctgaggcaggcagatcacgaggtcaggagatcaagaccatcctggctaacatggtgaaaccccgtctctactaaaaatacaaaaaattaaccagacgtagtggcaggtgcctgtagtcccagctacttgggaggctaaggtaggagaatggcgtgaacctgggaggcggagcttgtagtgagtcaagatcgtgccactgcactcctgcctgggcgacagagcgagactctgtctccagaaaa

SEQ ID NO: 351039 - DNA, 1896 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttgggagatacataaataacggttggcatttgggaggcctcaaccattcctgaggtactggtggtggcagttgcaagtatcttttgctgcactgaaggaggcaatgatgacgctggtacagatttcacttcagcatgggctggaatctgtaaatgatgcccagaaggcaaaactggagacttcacagtcactggaagactctgggtattaactacaataaaagatgagtctttttgtgttgagggaggaacagcaaatgtttgcatggtgagtccatcaattttcacaccatgactctgaactttagaaactgatgaagaaaaatttccagttcccacagaagtaactctacctttttctgatgtatctactgttcttgtaaggaaaatagtttgaagaactggctggctgaaaaatgggcacattgaactgatgcacttgtggaagagctggaaatctgagtctgaaaagtaacttgaactggttttcctgtattccctttcaaagcatcagacatgactgaagattgaactagtggtataagatttccagaagacttaggaattggaagtaattgcagaagattttttccatccgagccaatcgtctgaactacttggtacatgcagcctgaaacaccacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagggcgacagcgggctctcgagagggtgtatccccaggcttcgggacgaggtcgcgcaccgcgcagaaaccggaaggctcctggcggtggactgcgccctcacagccctacgctgagagagaatcggcgtgagtctccgccctcagagcctacgacaactctccagactccgccggagcaggcgcagggggcgtggccttggtggcaccacccccaacagagcctggtcagtgctgaagactgcgtcagtctggctctgccgccccgcccactgaagccgatagctggagcaaagctcggtcgggcgtcttccggggtcgtcacgtccggttgccaaggtgactggctcgctaaagcccaacccttatgatgcaatccaatggcaagtgatatttgctatcttttcttccggatcaaggaacaaatcgcaaaagaaagctctcccgacacctacgcaaaataaaatgtttccggggtcaatcataaattttctgcttctgtgctcgccgctagcgtacgtttttctctcccgtcagtgcattaaaagacatcggcgcgcttttttggagtcatgcacttctggcctgagaaaacttaaaacgcctgcctgtggccagcgattattgttgctgcttctctgaaggtttcccatttactcctctttcctgaagctttgcctctagacttacttaactctttcctccagcctacgttcatcgaaactatcacttattgtcatatagacctttatttctgaagggagatctgggagttgcatcagaacatccattgtattcattaaatcatttattcagctgtccattgcagt

SEQ ID NO: 351040 - DNA, 936 bp, Homo sapiens
tgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcggtgagtccttacagcagatgtggtgccccaagtcggggagatggtgcctaaatcccaggcaagatgtttcttggtagatcacttataggcacagaaagatcataggaaaatgagattggtacctcagatcagccaagtctgcccagaccaatagtatattatgtatgactagggtcccatggacaggtgaaagagggcattgctatcccccttgtagccatttttatattgctaataatgacttttgtcattattgtaattcccctttatagcattttattttttctttatgtctggatgaaatcaggtgtcatccatcttccaaaatcctcctcatgctagctattattatgtactttcagattctgactgagagtcgctaactaatggaaaataatttctaggctctttcctccccaaatgccaaaggatgcttccttaactcatgtctgcacaagatactccgtagagagatccaacttaggtgagggctctggctgcagccattgaggtctaa

SEQ ID NO: 351041 - DNA, 804 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttgggtaagtgtatctcttctgagcacggtttagctcacctttacccagctaagctctcctcattcctctactgaagaggctggtgtggggtaaaatgcatgcgtgtttgggtcatgtccagcacaaccatcctagaaacaaaagagtaataatttttcccctcttcctgccacagaataaacctgcaaaattgaaaggtaccagtgcagttattaatggaggtgctgtttctctctgagggctttagtttactactactcgtagctaacatatataggtgagaaacctgagactgtgctctggatattgagtgcctctgtttttcttgtctttttttctagattccttgaaacaataagtgattgaaaggaaagtcaccctttccagggaggtttcactgtataaaattcagcaattgaatttcagatataggatgggttggtacttgtgtatatgagaagattattataagtttggcttctctagttttctgcctagcaagatgagcttcctcaagcagggcatcttctctacatggtcatggtttctacagagaaagccatgtgtgagcgactgaaaag

SEQ ID NO: 351042 - DNA, 718 bp, Homo sapiens
  misc_feature (646)..(646): n is a, c, g, or t
  misc_feature (718)..(718): n is a, c, g, or t
tgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagttgctatcgaagccagactgtggttcatnccatttctgatatcggatcatcaccattggggatgtgtaatgaggggttgggatgcccttgccttgacccan

SEQ ID NO: 351043 - DNA, 430 bp, Homo sapiens
gtgaccttggccatcctgctctttgtatatgaacagaaggtaagttataaagacaacaacttattgtcttaatactgaaagtggggagtatgcagtggagaagttggtacaaagttacagaataagttctataatagagatagaaatgaagtggaaggatagaggaaacagagagtaattgtaattggggggaaaatttgtatgaaagagattgtatctgagtggtatcttgaggggtgcctggaaagagcagtaaaacaagtgtctcttcctctacttgctttcctctgtgtgtttggcaggagagaatgtctgcctcagtgcctaaggatagcccttgctttaattgctccttttcctcccttgtaaagccagagctctagaaggaagcaagcctactaaatacttcttccttcaatgccacctcatg

SEQ ID NO: 351044 - DNA, 1551 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351045 - DNA, 1467 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351046 - DNA, 2029 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctcataagaagaccccaagaaaccctacccatgggctgcaggaatcccacatcaagggggggccctatcaaaggagcttctgcggcgtaggggtggcctgatttcctggcctccgtccctgtagtaatctccagggggctgccctctaagagagacagggaaatcctaagagctgtgccagtgacgccgggtgatgttacaacccatggacatgccgagacacaagtcgttgcacggagccaatcttgtaaagcacacgacagcgctgtacccatccaaggggggcgaagcaccaatgatgtgggccaacatcacctccaccaaaagtattataaagcccgcccatgggggacatcacaacaaattccttgcgcgttataggtcgttgtctcaccactatgccgcctattaacaggccgatgatgaaaaaaatgttgctgcaacgcgagtatattatcttcaccagcagatattataccacg

SEQ ID NO: 351047 - DNA, 1788 bp, Homo sapiens
  misc_feature (1499)..(1500): n is a, c, g, or t
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcagtaagaagacttctggtattatctctctatcagataagattnngttaatgtactattttactcttcgactaagtgccctggctacaggaattacccagttctctttctccaaagggcaagatctcatttcaatttctttattaaagggccttattgatgtgttctaagtctttccagaaaaaaactatccagtgatttatatcctgatttcaaccagtcacttagctgataatcccacagtaagaagacttctggtattatctctctatcagataagattttgttaatgtactattttactcttcaataaataaaacagtttattatctca

SEQ ID NO: 351048 - DNA, 1167 bp, Homo sapiens
cactgcccagtaacagtgaaaaggggaaggggaaacggagcagcattctctctggggcccttatggcatgtggcaaaagtagtgacaatcttcaccagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctca

SEQ ID NO: 351049 - DNA, 1265 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaacacagtaagaagacttctggtattatctctctatcagataagattttgttaatgtactattttactcttcaataaataaaacagtttattatctca

SEQ ID NO: 351050 - DNA, 894 bp, Homo sapiens
actgaagaaacatccaaggtggtcttgaaggacactgggatcctgtaacacagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgagagggtgggggaatttcttttgactgaccctgaactggcagattgcaaaacaggccgaccatagactatgtctgcagaattttgtggggaactgtttaactcccgaatgccattattgatggcctccttgcacttcggtggccc

SEQ ID NO: 351051 - DNA, 1041 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 351052 - DNA, 1339 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaaaaaaaaaggcaagccgatccaaaagtatccctccatggacctaaactttacacataccacagttaccaggtacaaagtgaacccataaaccaaaatcttaactaactaccctaaaacaccattactactcatttaaacaacgtctctacccaattcacaacacctttataaaacatttccacacacacaagatcaccacaccaaaaccccttaaacctcccctcatcccatgtcaccccaatcaattatacaaacacaaacaaaacgcccttaacaccaact

SEQ ID NO: 351053 - DNA, 865 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgcctgagatgggatcctctagatcact

SEQ ID NO: 351054 - DNA, 498 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaagggggggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 351055 - DNA, 469 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccggtgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 351056 - DNA, 449 bp, Homo sapiens
ttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtca

SEQ ID NO: 351057 - DNA, 1048 bp, Homo sapiens
ggcccaggaggctgggcagctgaggcagggagggagggaaataactgtgcctgattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 351058 - DNA, 860 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtccatcaacgcctcactcatcgtacctgcctcagatgcggatcctctagaacacc

SEQ ID NO: 351059 - DNA, 731 bp, Homo sapiens
cttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccagacaccgtgtcctcttgcctgggagaggggaagcagatctgaggacatctctgtgccaggccagaaaccgcccacctgcagttccttctccgggatggacgtggggcccagctccctgccccaccttgggctgaagct

SEQ ID NO: 351060 - DNA, 2530 bp, Homo sapiens
  misc_feature (3)..(3): n is a, c, g, or t
  misc_feature (1400)..(1400): n is a, c, g, or t
  misc_feature (1601)..(1601): n is a, c, g, or t
ttncgccaagcttggcacgtggccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351061 - DNA, 279 bp, Homo sapiens
gtgatgtggtcagaggatcccgtcgtcagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttgggatggcggggaggaggggtacggagct

SEQ ID NO: 351062 - DNA, 463 bp, Homo sapiens
tgccttggtcattgcttgccctagaggatcccgtcgtagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttggatgcgggacgagtcgaccagcatcaagcaagattggaaatggagtccttctatgaaggagaagacttttctgagaccctgactcgggccaaattggaagagctcaacagggatctgttccggtctactatgaagcccgtccagaaagggtgggaagatactgattggaaaaggtctgatatggatgctggacgaggggtac

SEQ ID NO: 351063 - DNA, 669 bp, Homo sapiens
  misc_feature (96)..(96): n is a, c, g, or t
tgtgttttgttgttgtcatctgcctccatcttaagtgcatttcttcagctgtaagagctcccagtttcttattcttgctgtcttaaccttttcctngatgctggccacatcaatttcagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattcctcttgtctcttactgatggcttctgcttgtttcacaattggtttttccttaggtggaataaatgctttgtttctttcctcttgtttcttcagctgtaagagctcccagtttcttattctttgctttcttaaccttttccttgatgctggc

SEQ ID NO: 351064 - DNA, 9027 bp, Homo sapiens
  misc_feature (7897)..(7897): n is a, c, g, or t
  misc_feature (8098)..(8098): n is a, c, g, or t
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351065 - DNA, 9052 bp, Homo sapiens
  misc_feature (7922)..(7922): n is a, c, g, or t
  misc_feature (8123)..(8123): n is a, c, g, or t
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351066 - DNA, 3844 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtataaagcgtggagcgctttatacttctcactggaattcgtggaacatatttcttttttttttttagattgtgttggtgttgtggatttttttt

SEQ ID NO: 351067 - DNA, 3373 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaa

SEQ ID NO: 351068 - DNA, 2018 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaactggcactaagggtattaatctaagactaggttactggataagtcggaattctccttgagtagagtttggtatactatatttttctggatgttgtaatgagaacctatgcttggtgcaaaccctctgttggggcgggggtatccccagattctaacacagagttgcccacgggtatacataaatctt

SEQ ID NO: 351069 - DNA, 1807 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacccttaaaaaatggttgcttttactttgtttaaacccccccctttgcttcatatttggccaagggaa

SEQ ID NO: 351070 - DNA, 1629 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttgggaggcgggacgaggtcgtccagcttcaacggcaacagatgctgtgccgggagcggcataaagagccacccagggagctggacacgtcctcctcggatgaggagaatgaggacggagacttcacggagtacgagtgcccgggcctggccccgagcggggaactgggggggtgcaaccttcggttcgaccacgcggaatggtccgtgcccctgccgtgccccagctcaccggcggccatggcttgacctgggggcagacagacgcccaccggttcccggacctcgaggcccctgggggggggcagggcctggggcttc

SEQ ID NO: 351071 - DNA, 1514 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttggatgcgggacgagtcgaccagcatcaagcaagattggaaatggagtccttctatgaaggagaagacttttctgagaccctgactcgggccaaattggaagagctcaacagggatctgttccggtctactatgaagcccgtccagaaagggtgggaagatactgattggaaaaggtctgatatggatgctggacgaggggtac

SEQ ID NO: 351072 - DNA, 8983 bp, Homo sapiens
  misc_feature (7853)..(7853): n is a, c, g, or t
  misc_feature (8054)..(8054): n is a, c, g, or t
tgaccacgcgtcgcggacgcgtgggcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351073 - DNA, 8945 bp, Homo sapiens
  misc_feature (21)..(21): n is a, c, g, or t
  misc_feature (7815)..(7815): n is a, c, g, or t
  misc_feature (8016)..(8016): n is a, c, g, or t
gggtaccgggcccccccgtgncatttcgtaaccagaagcccgaagcccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351074 - DNA, 9199 bp, Homo sapiens
  misc_feature (8069)..(8069): n is a, c, g, or t
  misc_feature (8270)..(8270): n is a, c, g, or t
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggtaaatctagaattacagagactttgctttgtttgcatcagtgttaacctataacatcccaccatcaagttttcatatttgtgcttaggtaacaatagcgtgggcctggaaaatgaatgtaattgtaaaaaatgttgataatgtcttctttttttttttttttttgcaaaaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351075 - DNA, 8968 bp, Homo sapiens
  misc_feature (7838)..(7838): n is a, c, g, or t
  misc_feature (8039)..(8039): n is a, c, g, or t
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351076 - DNA, 9136 bp, Homo sapiens
  misc_feature (8006)..(8006): n is a, c, g, or t
  misc_feature (8207)..(8207): n is a, c, g, or t
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggtattttttaattagtggaaaacttgagtctcttccttaatactttttcagagtaatgaattttaacttgatctcttgatacaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351077 - DNA, 8568 bp, Homo sapiens
  misc_feature (7438)..(7438): n is a, c, g, or t
  misc_feature (7639)..(7639): n is a, c, g, or t
gaaactgtattgtattcaagggagattgactgcctttatgaaagatggagaagccactcagagcagttgaaggaactacttaattatttaattacattatttaatttggtacccattacctgatttttgcagtattaatcctcttctccatagctcattaaaatccttgtgactaattcatttttctttgcaaatttcaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351078 - DNA, 8290 bp, Homo sapiens
  misc_feature (7160)..(7160): n is a, c, g, or t
  misc_feature (7361)..(7361): n is a, c, g, or t
tctgaagtaggatttaaggaaatagtcttaatatagttgaatccagtaattggttcaattatgccatttatgccatttttatgtatacttgtactaatatataaagtattttatgatttgttttatcttaatctgaagaaatttctaactgctttaggcaagtgtttttatattttatactgtgatcacctttcaattattcaattataagaatactctgaagttaactgccttaaacatatattctttgttaaacatatattctttgttttacttggtaaaatctaaagtattacatgtgttgtgcttttaatttgtctagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351079 - DNA, 7966 bp, Homo sapiens
  misc_feature (6836)..(6836): n is a, c, g, or t
  misc_feature (7037)..(7037): n is a, c, g, or t
gtgatgtggtcagaggatcccgtcgtcagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351080 - DNA, 8183 bp, Homo sapiens
  misc_feature (7053)..(7053): n is a, c, g, or t
  misc_feature (7254)..(7254): n is a, c, g, or t
gtacccctcgtcccgcctccatatgggcccccgtgacctcctgtattgccgtgatgttgcatcctcctcttccccttatcctcgacacccctgaggctgggaccgaccatttctttgaccttcctaccacttctttccacccctcttctcttttctgaccccttttagggctagtgagattccgctttatgtttggagagcttaatggccatgacactgtcttgatgctggacgagtcgtcccgagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351081 - DNA, 7976 bp, Homo sapiens
  misc_feature (6846)..(6846): n is a, c, g, or t
  misc_feature (7047)..(7047): n is a, c, g, or t
tgccttggtcattgcttgccctagaggatcccgtcgtagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351082 - DNA, 4928 bp, Homo sapiens
  misc_feature (3798)..(3798): n is a, c, g, or t
  misc_feature (3999)..(3999): n is a, c, g, or t
ctgtccggtccggaatcccggggaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggcttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaggtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaaaaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaagtgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccattcaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataaatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagctgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaantgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattatnctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaaagtcatgaaaagttaccactaactgaattatggctttgtctagttttttctgggttttctttattttccaactcttaagatattaagtcaaagctgtcatctt

SEQ ID NO: 351083 - DNA, 2077 bp, Homo sapiens
  misc_feature (609)..(609): n is a, c, g, or t
  misc_feature (1357)..(1357): n is a, c, g, or t
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaaggtgatgttatgtgggaaccgaagcctggggtttgtgtacgttgagttgcgatgtttttttctttcgttcctcgtggacttataaaaccacctggagcctgtactgtgtagttgagtacctgaataatcgctgataagattttggctgggcccacaggaacggctggccgatatggtgccacccaggtgttcctaattcattgcttttgctaaagggtccccaaagcgaagctgttgcggattacgtcttttgtaaaaggatgagtattaagaaaatgcctagggcgacgcagaaccttgtaagcctgcgggtggctgaaagtcactgacggaatgaggaatagggtgaggtgggaataggtagtcatgatatacaagagtggaccctgataatggggtgaggtatggggaaaggagctatccgacatgtccttagctctagtntgtcagtaaagacattttgaaagattatcaattcctgtttgtcagatgctaaaatattagacgacacagcccttactgtttaggttgtgttaccttttaattgttaactcctgcgttgtagtctggttttacccgttttcttcagtgtgaatgatagagaagtcataaatagcctggggatctgttcaaccaggcttataggaagtgttaaaaacattgaactctcaatttagatgcattgggaaagtattcaaagtttctttgttgttgctcattaaatgattatgtaacgtacatagcaggggatacaacttatatagagtttaataaaaccatgcgggaaactagcattcagactaagtaaaatagagcattaccatacccctcaaacccttacgtgcacctctcagatcatattctcttttcctgtatcagacgtaaccaccctgaattgtgttgcattctgttcctcttcttgtagtcatgaagtggcttaatttagcctgttttttaattttatatacatgaaagtggaccgtatgcatttttctgtgtcttcttagatttagctttttgtttttcaaacagggtgatacttgcgggtgtagttttagtcttttcactgttatgtggtgtttccttgtatgaatataccccaatttattttttcattttactatcggtggacatttggattgttcccaattgcttgcaattataaacaatactgctaaaacatctttgtacntgtcttctggttaacatgttcaagggtttctctaggttgtgaacataggattggaatcactgaagtgtagggtgtgtgtaagtaatgctaacttttttccaaagtgctagtgtcagttttgttcccactaggagtggacgaaagttgtcattgccttacattagtatgaatacatgttatctgaattttgaatttctgtcattttggtagttatgaaatggtatttggttgcagttttagtttgcattttctgatcacctatgaggttgcatatcttttcacatgttttgaggcttccttaattgtgaaactcctgagtatttcttttgtcagtttttttcctgaggttgtagtggggattttaaaaaaaattatccatagcctttgaagtgtttaaattggatagggacttcgtcaggtaaacattgtaagtaactagttgcagtgactcacacctgtaatcccagcactttggcaagctgaggaggggggattgcttgagcccaggagaccagtctggtcaacatggcaaaaccctttccctacaaaaaaaaaaaaaaaattagccggacatgatggcacatgcctgtagtaccagctacttgtgaggctgaggcaagagaatagatcgcttgagtccaggaggtccaggctgcagtgagctgggatggagccattgcactccagcctgggtgacagagcgaggccctgtctttaaaa

SEQ ID NO: 351084 - DNA, 861 bp, Homo sapiens
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggtgagaactatgtattatcttcgattcattttcagcagagaacaaataatttggttataatatagtttattggataatgctttataattttatttctttagaatgtgctttgatttcccattagtaaatactttttatgtcatataattcaagggaatcatcatatctggaccctaa

SEQ ID NO: 351085 - DNA, 4122 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcag

SEQ ID NO: 351086 - DNA, 4420 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatgtagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtccatgaaatcaagagtgtgatgttctagttattttttcttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaacaaaaaaaaagaaaaaaaaaaagaaaagaaaaaacgagaagcgggcgagaaagaaagaacactccaagagacgagagagagaagaaaaagtaaagaaaaagaaaagagcagaaaaaaagaagtacaaatacacaagagaagccgaagaggagcaagaaaaaaacaaacaagcgacgacaaaagaaaacccaagagcacgtgcagggcatacgagcacagaacaagaaacacaccacaacagcgccaaggaacagaagaaaaaaaaggaacaaacacaagaaacagacacgagacgagagacgaaaacgaaggagcgacacaagaaaaacagaacaatgacaagagggaacggaagcagggaggggagagaaagagccggagatgggaaagaagagggtacgacgaccgacaccgaagaagaagacgcgagcacagaaaagacgtagaaaaaaagaaataaagaacaacaagacgagcgcagcaagaagacaaaaaaagctaagagaggacagggacggagagagaagagacaaggggagggaagacggaggagacaggcagacgagaagtacgagcgaggaacgtgaagagcaaagacgataacagaaggcggaaacaagggccaagacgcagagaagtagaagcaagaagaagagaggaacaggcagaagaccagagcagacaaagcccaagacagagagccagacaagaaaaagcaaaaaaagaaaaggaagagcaagacgacaacagacagacaggagaaaataaagcaacgaaaaggacgaagggaggaaaagatgaagcagaagaagatagaaaggaaagagacaacagaagaggaggcaaggagagagaaaagtagcagcgacaaacgagacataaggggagagaggcaagaggaggagagagggacaatcgagcgaaagaactagaaacaaggatgagaaaa

SEQ ID NO: 351087 - DNA, 1461 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttttggtggtggtggttgttcatagaagagtgttctttataaattatattattattgtattttttgaaaaatttatactagaaagtggtatatatgtctttgtatacattacgaccattgtgattatccattaaatccagtgtctgatgcta

SEQ ID NO: 351088 - DNA, 1340 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggcttttttttttttgggatggcggggaggaggggtacggagct

SEQ ID NO: 351089 - DNA, 1383 bp, Homo sapiens
agccggtagggtttaagaacagtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaaggtaatgctttctatgatgtaaaagtctttattaattaggaaaagtaaacccataataaatttgtctgaatctttttaagaaacagttgtatcttttcatcagttctcttagcatttcattaattactaatcctaaggacaagggatggctgagataatttataatttagaggcagctaatgcctatttcagtgcaaactggattgacagtcctctcctgacctctggtctgtgcttggaaaagactctttgttgtgaaagatacaaacccagggcagccagtgcatcttctgtagaaatgcaagaagatccctgagctctgctg

SEQ ID NO: 351090 - DNA, 945 bp, Homo sapiens
tcagcacccccgaacaacctccccctcaacataggctagtcgaggcctcgtgttaatcggccgagcggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggtattttttaattagtggaaaacttgagtctcttccttaatactttttcagagtaatgaattttaacttgatctcttgatacaggcattggaactcttaactaattgttacattatggttcagggaaacacagtttcagccattggaccttttagtggcttaaaagaggtgagaactatgtattatcttcgattcattttcagcagagaacaaataatttggttataatatagtttattggataatgctttataattttatttctttagaatgtgctttgatttcccattagtaaatactttttatgtcatataattcaagggaatcatcatatctggaccctaa

SEQ ID NO: 351091 - DNA, 351 bp, Homo sapiens
gatcccactggcttcccagaaagcagagaggcagctacatctcccagatcaggcctgacacaaggctttttgggagtagagtcctctctaggcttcaggggtgccctccagggtcacccagcctgacgtcccctccctcagttcccagaggacacttgccaccctccaaggcagctcagacaaaccaaagggggacgctccagctttcccaccaccatccatggggccactgtagtttcaggccagcacctccttcctggtccctgaggtgggaaaaggaaagacaatgagctctgtgtctgttggctggacctgcggcttctctcagccctcttctagtttcattcttta

SEQ ID NO: 351092 - DNA, 433 bp, Homo sapiens
ttctttggggtctttaactatttgtttttgcactattttatttcttagaggtgattttggagtcacaatacacatcctttctattgtactaccttatgtaaaatgtaagcacttgtagtcttttatgctacagttgtcatgttactgtatttacatgttataagccctacaatacagggttttgtgctttaagcagtctcatgtatattatggaagtaaagagggaaaaacagtgttttatatttatccaggtatatattaatatgatatctacagttcttttttcttttctggacactcagctttccacttgtggtatcactttcctttagctgcagaattttctttagcccagggatcagcaaactttggaagcctatgggccaaatgtggtccacctgtttttaatcaataaagctttattggaacactg

SEQ ID NO: 351093 - DNA, 772 bp, Homo sapiens
aattctgttaagatacaattcaagttgagatttgggtgaggacacagccaaacccatatcaggggctcttctgcctgttgtatcactcactgagtttgtgcctgcaaatggatataattatgcctgaaacagcgcatattgtatatctggtacaggttttgttttttttcccaagttttgccaaacactaaagtagaaagcatagttcatatgactattctatggacatctttagtgcttttatgagcatttttgatgaagaaattgaaagactaattggaggccacaattaagcattgactaatactaagttaggagaaccaataaaatctgtgattttacaaagtcaggtaccatatgttcatggaagttgtatatgaatgattatacatgtgcgtgcatgtatatgtattgtacgtatctgtgcctgtttcttgctatatatgttgtactcaaattacatttgcggtctttctttttgcattagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggtaagctgcctttttacaaagtgcctggtcatgttttagcactagctacagcttactgttggtgaaatatttataataaaactactattatttccattgttactgtggccatgatctgtgtatttaaaaaaagctaagaag

SEQ ID NO: 351094 - DNA, 336 bp, Homo sapiens
aaaaagtcttagagattaaaccatatcaggttacagagatctatgccattttagttaattattacatagagttcaattccaaaatgctttttttctcaggtttgtcagtctgaaaactgtacgtgtactaactttaaatttttttctttttgcatgtatttcaatattgaattaatacaaatgatttataaggagtgtccaattgataattgcttttcattttcaggctttaaaaaattggattgaaggaaatcctaaactcagttttctaaaacctggcatattgactggacgtggcaaaacaaatcagaacacaggtatttatatatagtgaat

SEQ ID NO: 351095 - DNA, 410 bp, Homo sapiens
aaaaatttagtagttgattaaaagaggtctttaaggtgggctctaatttgatgtgactggtgtccttgtaaagaaaaggaaatttgtacacgcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggtaagctgcctttttacaaagtgcctggtcatgttttagcactagctacagcttactgttggtgaaatatttataataaaactactattatttccattgttactgtggccatgatctgtgtatttaaaaaaagctaagaag

SEQ ID NO: 351096 - DNA, 4369 bp, Homo sapiens
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaacc

SEQ ID NO: 351097 - DNA, 4680 bp, Homo sapiens
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtatctccaaagtcagacgaatgcttcagaagagctataatcttcctaactcctattttcttactcttatggccacactgaagatgtccttctcaggtcccaagtccatattgtacaactcattatgaattttgtttcctttattcatttgttcacttagtaaatatgcattatgtgcctccatgtgccatacactgtgtgttagtaaaaacaaaaaaacgccctaccccagcaggaaagagttatatgaggggttgtggaaacattgtaccatttctcagacatctaatgattttgaatgctccttacaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaacc

SEQ ID NO: 351098 - DNA, 2751 bp, Homo sapiens
aattctgttaagatacaattcaagttgagatttgggtgaggacacagccaaacccatatcaggggctcttctgcctgttgtatcactcactgagtttgtgcctgcaaatggatataattatgcctgaaacagcgcatattgtatatctggtacaggttttgttttttttcccaagttttgccaaacactaaagtagaaagcatagttcatatgactattctatggacatctttagtgcttttatgagcatttttgatgaagaaattgaaagactaattggaggccacaattaagcattgactaatactaagttaggagaaccaataaaatctgtgattttacaaagtcaggtaccatatgttcatggaagttgtatatgaatgattatacatgtgcgtgcatgtatatgtattgtacgtatctgtgcctgtttcttgctatatatgttgtactcaaattacatttgcggtctttctttttgcattagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttccatttgtattttattaagagtgtcttttcttatgtgattttttttaattgctatttgatatggtttggctatatgtccccacccaaatctcatcttgaattataatccccatgtgtcaagggagggacctgatgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaaacctcttttctttataaatgaaaa

SEQ ID NO: 351099 - DNA, 2196 bp, Homo sapiens
tttttttttttaaatcacaattatgtactggttctaacgttctcttttgtgtgttattccatcccttcatctgtaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttccatttgtattttattaagagtgtcttttcttatgtgattttttttaattgctatttgatatggtttggctatatgtccccacccaaatctcatcttgaattataatccccatgtgtcaagggagggacctgatgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaaacctcttttctttataaatgaaaa

SEQ ID NO: 351100 - DNA, 3019 bp, Homo sapiens
  misc_feature (2961)..(2961): n is a, c, g, or t
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatattggncgcaactaatctcacacaggatgacgtaactttaagggacaaatcctgggtacacgac

SEQ ID NO: 351101 - DNA, 1425 bp, Homo sapiens
  misc_feature (1401)..(1401): n is a, c, g, or t
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccagtcattggctgctncctcgttgtgttgggataacatca

SEQ ID NO: 351102 - DNA, 362 bp, Homo sapiens
tgagataggtcttgctctgtcacccaggctagagtgcagtggtgtaatcctagctcactgcagcttcaaactcctgggttcaagcaatcctgcctcatgagttcactctttaacagctcaactttcctgggaagtgggattcagtgaaccaaagttgaattttaggagtacctctatttgtttacctatttgcagattatatcagagctttaagtcaaaaacaccaactaaaatatttattttctaataggcagaggaagagcaagaggtagcaagtgcttccttctgactagtaatgctggtgtaattgaaaaagaacaaataaacatgtacaaagaaaaaatgatgaatgactctatttt

SEQ ID NO: 351103 - DNA, 242 bp, Homo sapiens
gattgttacagttcagaaagcatgcatggtgttccagatgccagacaaagatgaagagagcaggatttgtaaagccctgtttttatacacttcacatttgcgggtacgttcctctttttaagagtcgtattctggtcacagcacctactgggagtggcaccgtggaagccaagataacatcaacttctcatcctgtcctcaagagctcacttaggaacctttccagaaagttcttatgaagc

SEQ ID NO: 351104 - DNA, 348 bp, Homo sapiens
ttttcaggaaagtggaatcacggattagcgacaaatttaaatacatcatagctcagctgatgagggacacagagagtctggcaaagagaatctgcaaagacctcggtgagataaatctcatattttgtgttctctctactggggaatagccatttattgttcactatcgtctttttgtgttctccttagttcagacaatgtcaagaccatatccagaggttgtcttccttgattataggttatttaggagccttatatgtcctcctctattctttctttcttcctttttttccttttaaatccaaagtaagttcatccagacacatgcacctgaaaaataaccatact

SEQ ID NO: 351105 - DNA, 287 bp, Homo sapiens
gatatgacccactgagctgtaatgtacaatggctttaaatcagatagtacatgactgacatttcttcagtaaaaattgataaagggaaaacttttgagataattgatcaataaactacagttaccttgcttagatttgctattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaag

SEQ ID NO: 351106 - DNA, 479 bp, Homo sapiens
tgcatgtatttcaatattgaattaatacaaatgatttataaggagtgtccaattgataattgcttttcattttcaggctttaaaaaattggattgaaggaaatcctaaactcagttttctaaaacctggcatattgactggacgtggcaaaacaaatcagaacacaggtatttatatatagtgaattagatttagtggattatgcatttaagaatatgtgtgtgtgtgtatgtatatgtgtgtgtgtatatatataatatatatttcaaattctgttttaatatatatttcaagttctgttttaatgcttctatcagtcaaggtttaaccacagaagcaaaagcagtaggtgattatacatatatatgagaggtgtgtgttgtatatgtgtccacatatgcatatatacagagatttcttgcaaggaattttacacaattgggctggcaaagcaagtctgaagcgtgtagggcaggtag

SEQ ID NO: 351107 - DNA, 4777 bp, Homo sapiens
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttccatttgtattttattaagagtgtcttttcttatgtgattttttttaattgctatttgatatggtttggctatatgtccccacccaaatctcatcttgaattataatccccatgtgtcaagggagggacctgatgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaaacctcttttctttataaatgaaaa

SEQ ID NO: 351108 - DNA, 4222 bp, Homo sapiens
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaacc

SEQ ID NO: 351109 - DNA, 2598 bp, Homo sapiens
tttgtcataaatagctctttattattctgagatacattccatcaatacctagtttattgagagtttttagcatgaagggctgttgaattttatcaacggcgttttctgcatctattgagataatcatgtggtttttgtcattagttctgtttataatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacggtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttccatttgtattttattaagagtgtcttttcttatgtgattttttttaattgctatttgatatggtttggctatatgtccccacccaaatctcatcttgaattataatccccatgtgtcaagggagggacctgatgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaaacctcttttctttataaatgaaaa

SEQ ID NO: 351110 - DNA, 2420 bp, Homo sapiens
gcactttcgattttccctttagttattaaagttcctatgcagctccgcctcgcgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagattgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgtaagctttttttctccttgtagataacaaatggacccagcactattcattgaaaagattgggctgggtatggtgtctcacgcctgtaatcccagaagtttgggaaatcaaggcaggagaattgcttggggccaagagttcaagacctgcctgggcaacatagtgagacctcatctcttaaaaaagaaaaattagctggtgctgtgcacctgtagttccagttacttgggaggctaaggctagaggattgattgaggctgcagtgatcatgacagcgtactctgcactccagcctgagcaacagaggtagaacctgtgtct

SEQ ID NO: 351111 - DNA, 3256 bp, Homo sapiens
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgagaaggcagaactatccgctgaggaacctggcagaagacga

SEQ ID NO: 351112 - DNA, 4625 bp, Homo sapiens
  misc_feature (4573)..(4573): n is a, c, g, or t
  misc_feature (4590)..(4590): n is a, c, g, or t
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351113 - DNA, 4083 bp, Homo sapiens
  misc_feature (4031)..(4031): n is a, c, g, or t
  misc_feature (4048)..(4048): n is a, c, g, or t
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctggggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351114 - DNA, 4140 bp, Homo sapiens
  misc_feature (4088)..(4088): n is a, c, g, or t
  misc_feature (4105)..(4105): n is a, c, g, or t
cccagcccctcacaccccacctgagcaggtggatgggcttgtaccctcactcccttccccttgttccctgcagtgctccgctcagccttacccgagtcacagtggtcctgctggtcatctggaaccaggcctcgcagtgtgtggaccacatcttcctggggaaccaggtatgtaggtgaggcctgtgtcccctcagcctgggccccttgtgcatgcccaccatggctcatgcctgcctgcctgcctgcccctgcctgcccgcagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351115 - DNA, 4060 bp, Homo sapiens
  misc_feature (4008)..(4008): n is a, c, g, or t
  misc_feature (4025)..(4025): n is a, c, g, or t
atactatactatactattcaattctttcaattctagtaatccaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351116 - DNA, 1213 bp, Homo sapiens
  misc_feature (1161)..(1161): n is a, c, g, or t
  misc_feature (1178)..(1178): n is a, c, g, or t
acagcaggtcccagtggagcctacaggttagcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351117 - DNA, 1944 bp, Homo sapiens
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtagggctgggtgtcccctgggttggagatgtcagggagggctttctggaagagatgagctggagggtctggtggaaagggagatggactggcacaggcaaaagccaaggtgggaatagggctctgggtggggctggctggggtgaggacagatgggaagtgggcctgtcgctgggggaaccacagtgttgaggggagggaactcatgtcagtgctgtgctccggcactcacatgacatacaggaggtgctcaatgtgtccttattgctaaatgggagatagaggctcagggtaaggg

SEQ ID NO: 351118 - DNA, 4635 bp, Homo sapiens
  misc_feature (4583)..(4583): n is a, c, g, or t
  misc_feature (4600)..(4600): n is a, c, g, or t
atactatactatactattcaattctttcaattctagtaatccaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351119 - DNA, 4545 bp, Homo sapiens
  misc_feature (4493)..(4493): n is a, c, g, or t
  misc_feature (4510)..(4510): n is a, c, g, or t
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctggggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351120 - DNA, 4075 bp, Homo sapiens
  misc_feature (162)..(162): n is a, c, g, or t
  misc_feature (179)..(180): n is a, c, g, or t
  misc_feature (193)..(193): n is a, c, g, or t
  misc_feature (4023)..(4023): n is a, c, g, or t
  misc_feature (4040)..(4040): n is a, c, g, or t
gggaaggcactggtgccccgtggagtcactccagtggacacctcgcggtgaccccgacaaatgattgcggtcattgttgctacatcgccgtgtgtgccctggcttggatacgatcgtgggaaagccatgtgccatcgtcaagttgttgatgtgaccccacantcgtatccttgtgtggnnaaccctagacagncgtgggcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcgggggggggggggggggggggtcaagatgagtttccctgtagattgtaccttggggtttttttctgtcgttttgttaaaattagcgccattttaatattaaaaatactgatttttaatattgaaaataaaagcatttaatatctcttaaagggcatccacatctgctttatccctagcggaagagtgagggggcttcacacgtgcactcacactgtggagagagttggatttcccagacccctgagggcacctgtcagggtcatccccattggtgctgcttgaggctactggggactgtggcactggacgtggctggagcaggtggtgtcacctgagtacattctttgctagcagacagtggatgaggccccttcctcttcctcaccaagcctggggctgtgccagcctgtcttaggccagggccttgcagaaggcgctccaggcgtggaagcagcgggtaaaggcgtgctgctcattgcccttgcggaccaggcgcagccggcgcggccgcaaagtttatttcccntttagttgaagggttanttttagcttttggcatttggccttctttttacaaa

SEQ ID NO: 351121 - DNA, 3807 bp, Homo sapiens
cggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagctacttgggaggctgaggcaggagaattgcttgaacccgggaggcggaggttgtggtgagctgagatcgtgccagtgcactccagcctaggcaacaagagtgaaactctgtctcaaaataaaa

SEQ ID NO: 351122 - DNA, 587 bp, Homo sapiens
gttacaattcaagatgagatttgagtggggacacagccagatcatatcaccgtgcaatactttcttccccataccagatacagacactttaaatacatgtttacccttgtttcttttaactgaactgtgagaaattttgctcccatagtcattttaaatgttactgttgaaataagtatgtcagtgatcactgtcagtatgtggcccccaaggagtagatttggaatatattaagtcatttagtgcctaaaagtatgtttggcactggtttgctactgaaatacgtggcaaggtaactgcatcaagttgttccctatgtgtcatctgaatattcacgtagtgatgtatttcatactagagattttttttcagggggtacaggcataccacggagatattgcaggttcagtttcaaactgctgcaataaaacaagtatcacaataaagttagtctcatgagttttttggtttcccactgcatataaaagttttattcacacaatactgtagtctatcatgtgtacaataagattctatctaaaaaacagtgtacataccttaaataaaaaaatactttattgctaaaa

SEQ ID NO: 351123 - DNA, 2919 bp, Homo sapiens
caattttaatagttttacaactgtcaaaactcatttctaaaatgatcacaactaaaagccatattatttaaaatgcttttgaactgaaattttattataacattgacaataatgtatttttttccttaatccacctacctaattttctgaaggaaagtagtactattttgtgtattctgtggaaatcaactgtaataatatgttacttgaaactaacaataaatgaggtaagaagctttatgtgtgtctgtaagccaataaggtttcttaaagaatcaaaatttttaataatgtgagcagccaacctccagatagactgacagagatcttacatcagtgtctctcattgtcccttgctattccattttgaggtttagtaaagataaaaatcttagaatattgttgcccgttctgggattagtcagatcccttgaaggtccaaaaattagtcatgatgcttgtaagctgttttcaaagcctattagaatttatgctactgcagtttacagtttttaatgtatagtctgtatctttaccagcctcattccttaacaacggaggaatgcaatttcaatggtaaaatgtttttaaacattgaaaagaaaagtaacaaaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaa

SEQ ID NO: 351124 - DNA, 2413 bp, Homo sapiens
atgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaa

SEQ ID NO: 351125 - DNA, 3892 bp, Homo sapiens
caattttaatagttttacaactgtcaaaactcatttctaaaatgatcacaactaaaagccatattatttaaaatgcttttgaactgaaattttattataacattgacaataatgtatttttttccttaatccacctacctaattttctgaaggaaagtagtactattttgtgtattctgtggaaatcaactgtaataatatgttacttgaaactaacaataaatgaggtaagaagctttatgtgtgtctgtaagccaataaggtttcttaaagaatcaaaatttttaataatgtgagcagccaacctccagatagactgacagagatcttacatcagtgtctctcattgtcccttgctattccattttgaggtttagtaaagataaaaatcttagaatattgttgcccgttctgggattagtcagatcccttgaaggtccaaaaattagtcatgatgcttgtaagctgttttcaaagcctattagaatttatgctactgcagtttacagtttttaatgtatagtctgtatctttaccagcctcattccttaacaacggaggaatgcaatttcaatggtaaaatgtttttaaacattgaaaagaaaagtaacaaaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgcc

SEQ ID NO: 351126 - DNA, 3360 bp, Homo sapiens
  misc_feature (3335)..(3335): n is a, c, g, or t
caattttaatagttttacaactgtcaaaactcatttctaaaatgatcacaactaaaagccatattatttaaaatgcttttgaactgaaattttattataacattgacaataatgtatttttttccttaatccacctacctaattttctgaaggaaagtagtactattttgtgtattctgtggaaatcaactgtaataatatgttacttgaaactaacaataaatgaggtaagaagctttatgtgtgtctgtaagccaataaggtttcttaaagaatcaaaatttttaataatgtgagcagccaacctccagatagactgacagagatcttacatcagtgtctctcattgtcccttgctattccattttgaggtttagtaaagataaaaatcttagaatattgttgcccgttctgggattagtcagatcccttgaaggtccaaaaattagtcatgatgcttgtaagctgttttcaaagcctattagaatttatgctactgcagtttacagtttttaatgtatagtctgtatctttaccagcctcattccttaacaacggaggaatgcaatttcaatggtaaaatgtttttaaacattgaaaagaaaagtaacaaaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaagagaagagcggagaagaaacagaagagagaatcgagaatacaataagagagagaaggagcaacatagaagagaagagacgaaaagaagagagaggcaggaggaaagaagagcagagggacagagggaggcgggcgcgccattcataatagcagcacttagacgagagcgcagatcagacgcatggcaaagaaatcagataggaacaaatcagagcgcgagacaacagacagatcgagatcgcacggaaagcaaccaccaacaggagagagacaagaacgtgagaagagaatgagactagcagagagaganagatcctaagacgaacaacgacgca

SEQ ID NO: 351127 - DNA, 2563 bp, Homo sapiens
caattttaatagttttacaactgtcaaaactcatttctaaaatgatcacaactaaaagccatattatttaaaatgcttttgaactgaaattttattataacattgacaataatgtatttttttccttaatccacctacctaattttctgaaggaaagtagtactattttgtgtattctgtggaaatcaactgtaataatatgttacttgaaactaacaataaatgaggtaagaagctttatgtgtgtctgtaagccaataaggtttcttaaagaatcaaaatttttaataatgtgagcagccaacctccagatagactgacagagatcttacatcagtgtctctcattgtcccttgctattccattttgaggtttagtaaagataaaaatcttagaatattgttgcccgttctgggattagtcagatcccttgaaggtccaaaaattagtcatgatgcttgtaagctgttttcaaagcctattagaatttatgctactgcagtttacagtttttaatgtatagtctgtatctttaccagcctcattccttaacaacggaggaatgcaatttcaatggtaaaatgtttttaaacattgaaaagaaaagtaacaaaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaatgagatacttcaattggaagagaagaaagggaaattcggttaataacgatggtgggccgcttagaagttttccgagaaaggttattattggg

SEQ ID NO: 351128 - DNA, 2156 bp, Homo sapiens
caattttaatagttttacaactgtcaaaactcatttctaaaatgatcacaactaaaagccatattatttaaaatgcttttgaactgaaattttattataacattgacaataatgtatttttttccttaatccacctacctaattttctgaaggaaagtagtactattttgtgtattctgtggaaatcaactgtaataatatgttacttgaaactaacaataaatgaggtaagaagctttatgtgtgtctgtaagccaataaggtttcttaaagaatcaaaatttttaataatgtgagcagccaacctccagatagactgacagagatcttacatcagtgtctctcattgtcccttgctattccattttgaggtttagtaaagataaaaatcttagaatattgttgcccgttctgggattagtcagatcccttgaaggtccaaaaattagtcatgatgcttgtaagctgttttcaaagcctattagaatttatgctactgcagtttacagtttttaatgtatagtctgtatctttaccagcctcattccttaacaacggaggaatgcaatttcaatggtaaaatgtttttaaacattgaaaagaaaagtaacaaaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgaaatgacctcctttaacaagacactcatctcaaacaatgccatttagttcaggagatctctaagtgtagctgtaaattttggggttaatttggcttatattggaccttttaaaagaaataaagttttttaatgc

SEQ ID NO: 351129 - DNA, 458 bp, Homo sapiens
atgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagcccagtgaagtgccgtatatccatgattgtctgctgtggctggatttgcatccatagatgctgctgactgcaaaagggctccaagaacaccaatgtgtccacaggcagcagacaggtgtataggcgtccggcccctgctatcccgaagtaagcacttagcaccatgttgaagt

SEQ ID NO: 351130 - DNA, 1909 bp, Homo sapiens
  misc_feature (25)..(25): n is a, c, g, or t
gggctaggtagcgaggctgggtggngcatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggatttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaa

SEQ ID NO: 351131 - DNA, 462 bp, Homo sapiens
acctctgtctacatctctggcataaatttaagactttatttgtgaatattcagataagcactttgcctctaacggtattgttcagggcccagcatcattgttacagctgtaattgtaactatcaagacacagttctttgtaattagaaagtcaagatggtattcagcagtatggcagcacagacttacatttgttaggctattagaaaaaaaaatgtttacagagaaaacagtgtcattgtttagtgctcttaattgaccatctgcctggtaaagaaatgtccaaagaaggataaataagactatagtacacttatttatttattttctttgtgcagtgaggaaattaggaaaagcaacagcggaggcaaactagataatacgtttctaaatcaggctgcaagtgaaatcatgccatgcatatgtttctttttaaatttcttccagtgtcaagacaaagacc

SEQ ID NO: 351132 - DNA, 517 bp, Homo sapiens
tttttttacaactagggcctcagtggataaaataaccttgtccacctgttatttcgtattgtgaatttgtatcttcagggtagatgcttagatatggagttgctgggccaagggtgtgcaatggtttggatatggttttgggggccccgccaagtctcatgttgacatttgatcccagtgttggaggtggggcctggtgggaggtgtttttgttgtggggtagatccctcatggaggacagcatggtgccattcttgtgggagtgagtgagttctaactcttagttcccactagaatgggttgttgaaaagagcctggtacctcctttcctctcttggctcccctctccttatgtgatctgcatacactggctcccctttgttttcagccatgagtggaggcagcttgaagccctcaccagagacagatgctgcaccataattgtacagcctgcagaaccatgagctaaataaacatcttttctttataagttacccagcctcagttattcctttat

SEQ ID NO: 351133 - DNA, 4016 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351134 - DNA, 3839 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351135 - DNA, 4169 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacatcttggtctgtgatgtcttcattgcacctccatcttccatttctgggcctccacaaaacagtaagagtaacagccacagataaagcacctaaaggccaaggtgggaggattgattgcttgaggccaagcgttcaaaaccaacctggccaaaagcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351136 - DNA, 4709 bp, Homo sapiens
  misc_feature (3821)..(3821): n is a, c, g, or t
cggacgcgtgggagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggtgaggatgcagcacccttgggcaggtggcttctcctctcccttgaggccatctcatgccttcttgcctggcctgggttccgtttgaagagagacagctgcagctccctctaggctctgtgccccctgctcaagcctggccatgccagctcccctgtgcttccctgtccacctcctgttctccccgcagtccacctggcgcccgctcacagcccccggccccggcctcagccctcagcctggcctcccttgctccttgccctcccctaggcaagccccacacctctgtgcccaggtggctctgcctttaccccaggcctggccccagagctgactcttactctagaaacctctgccctttctggaaccaggctgtagttctccagcaaatctaccccacactcccaacccacattccttcaacccagccagcttccttctttcacacatcctccctcaagctcagagcaaggacttggttcagacagacctgggttcacatcccggctccaccctctcctagctctgtctccatctttctgcaccttgggttccccctttcccacaggtagttgtgaggctaaatgagccagtatagtccacgtgctccgcacggtgcccggagcatggtaaatggctggctaatggtggcagcggccactgtcattcctgccaggggaaaagtgccgttgagcgctgcctgtgcaggtgtcttgggcacggggacccaagtgacagggcttgggtatttcggcaggcctttatcctgcttccccatggcatggagctcctgggcccggcgccccttccctgcctgcccacccgggtggcctttcctcttggcagccaggccccaggggccngaagccagagtccagggggaggaggacacgtgcctgccccggcccctcgggagtccgtggctgttttgtaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtgtttcttgcccagatgaagtttgtgttttgtggggggggccttgtgtaaccacggaattcctatttatggcatttcatgccttgtaaatagcaccaggagatgaggaagagaatgtacatatattttctaaggaaaaaaatctgttactttcaga

SEQ ID NO: 351137 - DNA, 494 bp, Homo sapiens
aggcttgtctgtcctctcccctgcttgcattccatgtgcatctaaagtggacttcactggcccctgcgctgtccacatcctccccaaatcctgggggcccagcaagcgtgatgtgcccttgaccttcactcagaaaacaagaaaccccacagccccctcccatctccccttccagccctcaaacaaaggtgctgcaggtctgtgtccagccctgaccactgccaagccccctccccttgagaggcagtgcgtcctggccccaggcgtagggctgatgagcactagggcttcagcctggtcttacagctgtcttcccttagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351138 - DNA, 654 bp, Homo sapiens
aggcttgtctgtcctctcccctgcttgcattccatgtgcatctaaagtggacttcactggcccctgcgctgtccacatcctccccaaatcctgggggcccagcaagcgtgatgtgcccttgaccttcactcagaaaacaagaaaccccacagccccctcccatctccccttccagccctcaaacaaaggtgctgcaggtctgtgtccagccctgaccactgccaagccccctccccttgagaggcagtgcgtcctggccccaggcgtagggctgatgagcactagggcttcagcctggtcttacagctgtcttcccttagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtgtttcttgcccagatgaagtttgtgttttgtggggggggccttgtgtaaccacggaattcctatttatggcatttcatgccttgtaaatagcaccaggagatgaggaagagaatgtacatatattttctaaggaaaaaaatctgttactttcaga

SEQ ID NO: 351139 - DNA, 3536 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351140 - DNA, 3785 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351141 - DNA, 719 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagccacagccaggatgtcattacgttcctctcttgaagggttccagcagatggaccatattggcgagagggagccccccg

SEQ ID NO: 351142 - DNA, 410 bp, Homo sapiens
ggctcagaccggcttgttcttctttgggtctagagtctcccaaggaggcaccgccacagactgtggcatcacggttttgttttacctgatctcaaaatgactgatgcaactgggatgtctttgctgttctttacatggtccaatcccatggataaagccatgcctcgctgggtggtataacctcctgcacgcacgatgattaatctgtgcttgctcccttcctctcctctgtggctcactgtctagatagagcttgacttcccacccctagccaatcacccacttttgaagccaagaagacagcttattttattctttatttcttcgccacaggccttcatcagagtacaagacctccgatatttagagctcatcagcagcattgaggtaaaagatgaagcatttttcct

SEQ ID NO: 351143 - DNA, 3683 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351144 - DNA, 3684 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtactgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351145 - DNA, 2747 bp, Homo sapiens
  misc_feature (325)..(325): n is a, c, g, or t
  misc_feature (364)..(364): n is a, c, g, or t
  misc_feature (402)..(402): n is a, c, g, or t
  misc_feature (862)..(862): n is a, c, g, or t
gaaaacaatacttcaagctccacatttgggaaccattagcacagaggtcctggctgatttctcttccctgcccaggaagccaggagagatgcaggccactgaagcacactggctggcctaaaacaagggcaaggcctttccttgttaaagatgtcatggcccaactcaagactcattctcaggcctgcacgcacatatgcacatatacacgcgtgcatacatgtggcaggaaggggcacagaacctggagtccagtcacctctggctattgccagctatttgctgggacaggtcatttgtcctctctgagtctcggtctcctggnctgtagccagggagaaataatacctactgcacaggactntggggacagccaaaagccttttataaacctaagaaagngaagtcgttaggaactattcatgggcactcacagcaaggcaaccccatcttgtaggagggcatctgtccccagggcagggatcaggagagctgtttccagaggcttccagggtaacttggagcaaatcacttacctttcttggactcagtccctggaagaagaggccattccagaccgcttcctcccacgaactcattcattgtgtcagcaaacgtagactggggttctgctgagggaggccgatacaacccaccactgcccacggctgtgcacggctttgctgtgggaacaggcctgtaactgcggcacaacctgcgatctggacaaagggcagaggaagctgagactctttcccctggggtgggggcttgaggggcttgggaggactctgcagaagaggtgacatttcaacagggccttgaaagccaaataggtattttccagaggcagagtggggangggcaaaggcattccaggtgagggtgacatcctatggcgaggcaggcctgtaggtgggaaggaggggaggatgggcagagagtttgtgctgtggagcacagtagcccagtcatgagagaggtgcaggatggagcacacagggtgggctgggcaggctgggcagggtgctgattggcggctgcagggctgctccccaggcatgggtaatcatcccacgcatctggaggcaggctctgtatgcatctggttctttccatggctctgaaaacagtcttctttttttcccttgatgaaatcctgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggtaagcatctagccagcaggagctggagtttggtccttgtggggtcccttaagaaggcagatggggacccaggtggcacggagaggccatagactgcagcagtctctggagttaggctgacctgggcttgtatcttagccacttcctcactgtgggcctgggtaggtgacaccctttctaagattgcttctctatagacgtaggatgatgacaggccccatcctcacaaagctgtgaggatcaaatgggaggatgcctgtaaagcctgacccaggagcagcatgtcagattctggctgtcactcttattagctgttctctgtgggaagcacctgactagtagcctggcacatcacaggcactccgtaaatggcggcttttattatcggtgtagtcactggccatgatgctgcacacaatgctgcttttcttagcatctgccaactaaggtgggagagatggtcaaggtctctgattctgacagcaatgtgggcacttcccacgtaccttcatggcgggattcatggacttgattcgttgtgtcctttcctggcctagtctatgaaagctagagagatggctgaaaacatctgacccctctctgcacataaggaaaagcccaggtatgttcctgagctgtgtttccatctagaacctcagatggaggaaggaatggcttccaacctccactcccctaccccttccctctttatctccccacagtcaattaatgagctgctcattttgtccatattcccgggctgacattgaaggagtggcaaagagggacgtgatgcccgccttgggttagatcaagacttgtaggcatgaagagaggagactggaccagaccaggactaagaagcctggctgagaacgagctgtgtcacataaggggctctgggacctcaggccagccactttccttggagccccagtcctcccagttctgaaatgggggtggtgagaatgcccgctgcagtcatgaggcttaactgagatgttgtaaaggggaatttaaatcagggatggttgtgcagatgctagccattactaaacaagggaagtgatcgttgtgtaacaatgatctagattatatttttagatgtcctcagtgtaggaaagtggagatggaggaggctgtaagaattcagaggaggggccaggcgcggtggctcacgcctgtaaatcctagcactttgggaggccgaggtgtgcggatcacaaggtcaggagatcgagaccatcctggctaacacggtgaaaccccgtctctactaaaaatacaaaaaattagccgggcatggtggcaggcgcctgtagtcccagctactccggaggctgaggcaggagaatggcgtgaacctgggaggcggagcgtgcagtgagccgagatggtgccactgcactccagcctgggccatagagcaagactctgactt

SEQ ID NO: 351146 - DNA, 220 bp, Homo sapiens
ataccctctcagctttcccctcctctgctccctctgtggtaccaggggctctgggtcccctgtgtctgtggcaccactgggtaggcatagctgtcccctgcattctacccatgttgccaagatgtataggcagtctctcatcagtccatgcatctcatcctctcctgctgtgatgctgcgtgaccccccagaggctcagaccggcttgttcttctttggg

SEQ ID NO: 351147 - DNA, 3754 bp, Homo sapiens
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351148 - DNA, 3189 bp, Homo sapiens
  misc_feature (59)..(60): n is a, c, g, or t
ttcattaaacgtcttgggcaggctgtgcagacaggaacctggagatgtagaaaagagtnncaggatgtcattacgtcctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351149 - DNA, 776 bp, Homo sapiens
actgcccctgcacacacacacattgctcctgcacacacacacacacacacacacacacacacacagagactgctcctgcacacacatacagagactgcccctgctgcctcttcttgcttttggtgaagctgccagtgggttgagaagcaactctgtggtcaccccacctgcctggcggcaagtcctttgcaaggcctccagccccctcagccctttctctatgccctccagacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 351150 - DNA, 562 bp, Homo sapiens
cgatctagaggcatccccaggtgtcgtgcctgtgctgtactgtcctggagggacacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcagaaactacacagatggatcatgggtggtggtgaacgtacgac

SEQ ID NO: 351151 - DNA, 2602 bp, Homo sapiens
acatgtacccttactgttctgtggagcttattttgggagtggaagcagcagcattttcgcttaagtatgaatttttaggtgatacttgagtttctcttttccacttctgaaaggtccacattagaagtatgatcagtcagaaacaactttttataccacctcccaccagaaaagcttccctagttcttatctacacttctgttctcagcatttttctttgaaaacgctacattctttgaaatttgaaattagtcagtgacctactttggactcttgtctctttccaccctgatactggtttgtttgctgtggagatgtaagcagactttaatacatagctggaaggatttttaaaaattctgctttataaatattcaaagcttcacaagtaattgtgggataattgattttctgttagaataggaaattgacatttgattagaggaaacatttcttccttgttgggtgattgatgagtatctttttctacccgaaatcattccttcaacatctgggttgggtcagtgtgtcagatacatgaagtatgtgccctatgatttcttttctctgtcagctttttcttcaccatagcagtttttaagtagctctgtggaatggaaatatacatatttagagggtgggacataggctaaaagaaagcttgtcacaagttgacactaggtcttcctaattgtcaaccagaggcacttactgatataactgaagcagtttttgtcctgtacttactcccttttgtggtcttcccttccacccaccctttttttttgttccttttttcctctgttacagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactgattgcataccttgaggcacctcctccagtattattttgttcattttgttttcctttgttaacattggtgagaatgaaactattgtgagcttgttaccgtttcctttttactactttgggggataactgggtgggggtgggggagtggtaacccttgtttaggtttaggccatttcagctgagtgcctgtttcagggtctgacttgaattctttatctagagccacagttttctcttctttcttgtttgttacttttctttgtagctttattctgccttgcaatataacaatgtgttaggctctgtgttaatgaataaaagctgcttcgttaacttttttttttttttttaagaattatttaatggttaagctatcagcaggccttcttggccatatttgtgtttctagctgtaataaagttggcgcagtaagaaccttagtacactgtgtgctgtgaagggtaaagggttgggggcttgtgacttgtggctattcagctaggaagcctgtataactgacatgggctttttgaatcccaagtgaattttatagtcgtttgtcaatatttccacaaagagataacgagtctgtggcagtttagatcctgaaggtcctctgtaattggcaacaagcttcactagtgaggaagtttatctgacttctcagatggccttaccttgccagcagcagctaacaaggtgttcatcccaggattcctctggtgaatggttaccatgaggatctcttccaagtcatacattcaaagaacatacttctttacccagaatgaaggggaggggcaaagtgggataagtctaataaaattaggcagcttctgtctgcattcctctgaattagcattatgcctctttctgtgacattaggtatatctcagccaacccgtgacattatccacaacttgacatgatgccatccactagtcctaaaccaactctgtcaaccaagtttctttacccttttttctattcctggccgtatcctttctgctccccaccagcactatcaggagtaggaagtgacatgcttagatttggaaggaaccttaaggatcaactaatctgtaacacattgatcccctcattttacagattaaaaaatagaggccctaagataatttaaattcataggttatgagtgactagccaggactaacaacttaagctttacttttactcaatcgtactaacctccctgaaatcttgttcattttcttatactaagatgggcacaggcctctcataaaacagtagaaatgttcttagtatggtggtataaggcctctgatagccttccattcaacgagagtacacgttgccacagtgctgaaagtgtaatgctcttcccagggcattagagaactcagtgtagagatagtttccctgatgaccttttcccagcatcaccattggctgacaaaaaaaaa

SEQ ID NO: 351152 - DNA, 648 bp, Homo sapiens
atatcgaattcgcggccgcgtcgacagacgacagaggggatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagcaaaaaaaaaaaaacaaaacttaaaaaaaagcggcctgaataaattgccccatctgtccttaatacctgtagcaccccggattccctctctctatagctgccgcccccgcggtgaagcctccacccttcgacacaaaaaaagggggtcctttacaagtttgccgggcccctgaatccctcttttttttct

SEQ ID NO: 351153 - DNA, 797 bp, Homo sapiens
ctcatgcctgtaatcccagcacattgggaggcagaggcaggcagatcacctgaggtcaggagtttaagacctgcctgggaaacctgttgaagccccgtctctactaataatagaaaaagtagctgggagtggtggtggctgccagtaatcccagctatcaggtggaggctgaggcaagagaattgcttgagccagggaggcacaagttgcagtgaggcaagatcacatcactgtactctagcctgggtgacagagctagactctgtctcaataaataagtaaatctgagtataattcttgacccatagttactctttttacatctctttttaacatttttttttttacctttaaaacggtattacctcataataccctacacattgatagaactccagggctttaaagtaaaggccttgagttgtctcagcattaaacccttgagactactctcagatgactctttctttcctaaactggtattctgtcagcagtttgggaggagccaaagtgagctcagcaataaagaaacattgcttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtgatgctgacgactgtccggccgt

SEQ ID NO: 351154 - DNA, 961 bp, Homo sapiens
tagttgttaccccacagtgacaagatgacatcaagtcagtcccagaaatgtctacatggacacggtgtgatgaaggtggttaatgcacctcacatcggtactatgctggaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgtttgtttaaaaatggctttataaaagggctttataacccaaaaaaaaaaaaaaaacaaacaagaaaaaaaaaaaaaaaaaacataaaaaaagaaacaaaaaaaggaaggggggcccaccaccaaaaatttcacccgggagggggccgacaaataaaggccgaacccagttttgttagaaaagagagggtcccccaagaagagacggcagtataaaaacaaagcaaagagcaacgacggcgcagcggatacaaaaaacgcgtgagaggagaaacagccagatggagcagcacgaagaactgatgcgagaaacaccaccaacatcgatagggggcaaaaacatggggacaacaacacctcgaacgaaatataacgagcctgaggcaacaaaaaacgatgaacagacggcatacgagtggaaacacacacgccaatacagcggcagaaagaattcgtccacgagtcactacacaaaatcttcaggcagtgt

SEQ ID NO: 351155 - DNA, 310 bp, Homo sapiens
  misc_feature (275)..(275): n is a, c, g, or t
cgtccttcatcatacctaccaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaggggnatgacacgggatcctctagatacccaagcaacacc

SEQ ID NO: 351156 - DNA, 627 bp, Homo sapiens
  misc_feature (434)..(434): n is a, c, g, or t
tgtggaatggcaatgtccttgaatggtataggcctctagaggtggtctctccaggtcaggtttgaggcacattcacggggtggtgtgtggaaagctcgtactgtcgctgcctgtgctgttcctgtcctgaccacctgcgaagattaccgaagttcttgactgtaaaatcccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggntgcataatcgccggttcacgagacccttccttgtactatccctatgaggtataattataacaagctccatctgcctacgacaaacagaccttaaatcgctccattgcatactcttcaatcagccacatagccctggtagtaacatccgttcttatcacatattatcgccaggtcacgagatgggtcccacgag

SEQ ID NO: 351157 - DNA, 1408 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgt

SEQ ID NO: 351158 - DNA, 2046 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctat

SEQ ID NO: 351159 - DNA, 1667 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccatattggggagattccatttggggggatcatatgggggggactcc

SEQ ID NO: 351160 - DNA, 1593 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagc

SEQ ID NO: 351161 - DNA, 1646 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccatttgggggtgggatcctctagaa

SEQ ID NO: 351162 - DNA, 1653 bp, Homo sapiens
  misc_feature (1621)..(1622): n is a, c, g, or t
  misc_feature (1626)..(1626): n is a, c, g, or t
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttgggtgtttttttttggggcccaggaaatttccgggttggccagggaattgtaagaggggaattttaatcctttcacagttaagtccgtgtaagtgtcgggaatttttccaaaaaatttaaaaggagggagcggggagctttccttgggggaatagaanngtgnttgccgcagctgtaaaaaaaaacacag

SEQ ID NO: 351163 - DNA, 1636 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttttggggttttttttttgtgggcctcatggaattttcctggttggctcagtggaaattgttaagaagtgtggaattttaatcactttccagttaagtccgtgtaagtgctcgggaattttctcaaaaaatttaaaagaagtggccgtggaccttttcctgtgggtgaattagaac

SEQ ID NO: 351164 - DNA, 1875 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttggggtttttggggcccagaaatttccggtgggccgggcaattgtcggggggcatttaaactttccgtatccggaaggtcagggattttttccaaaaaatttacacagtgtacgggactttctttgggaattgcgcacaacagagtagcacagagaacaaaaaaattgtttgggggccgcgcagcccagagaaggttttaaacacgtctggttggggcccgggccccaagagggtatggacagtgcacaagggtcacagagagaccggcgagacagtggtgggtcccccaaaaaaacgcggggacgagggttgaacaccaggcggttgggctacgggctaacaggccggcatctcccccgccgcgcggaagaaggcaaaccatacacggacaagccataacatagacaacaca

SEQ ID NO: 351165 - DNA, 1522 bp, Homo sapiens
  misc_feature (1485)..(1485): n is a, c, g, or t
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttttttttttttttttttttttttnttttttttttttttttttttttttttttttttttttt

SEQ ID NO: 351166 - DNA, 2149 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttttggggttttttttttgtgggcctcatggaattttcctggttggctcagtggaaattgttaagaagtgtggaattttaatcactttccagttaagtccgtgtaagtgctcgggaattttctcaaaaaatttaaaagaagtggcacgggagcttttccttggtgaattagaaacgggattcgccacaggttgaaaaaacaaacaacaaaaaaaaaaaaaaaaaaaaaaaaaaaaaaaggggggcgcgcccctcttagatgaaattctcccccccagagggcccccacattaacgggtcaccccagttttttttgcaacagagggggccccaatagggcggcacgtaataataaaacaacaagagcagcacggggcccgcgattaaaaaaccaaggcgcgcggggcggggaacaacacccgggctgccgtgagcactcttggagaagaagagccccacaacttcgggggggggcaccaactattgcgggccgacacccccccagagagagtataaaagcgcccagggagaaatacaacatcaaccgggtgtaacgggggacaccacaccgatattttcctgcggcggagaaatctgtgtcagagactaaatatagaaatagtaggagaaataacaatagtaaacccccccgcacacgcacgagcaagacatagcacatcacactcacgt

SEQ ID NO: 351167 - DNA, 1721 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtgcaaaaaaaaaaaaaaaaaaaaacaaagaaatcttggcgcggcggctcgggcgcccagagaaaaaaagcgtttaaaaagacccactcccgtggggggggccgcggccccacatgagggtacagttgagccactgtggccacacagcgtggggaccaaaaggagaacaccggcgcctcagcacaaagcgccgggtttttcccaccaataaaaaaacgcgcgggggaaccggggcgtctggaccaccccaaagggcgtccgggcgcacacgggtccaacacaagggccagaggcgataccgccgggggggggggc

SEQ ID NO: 351168 - DNA, 1698 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtcaaaaaaaaaaaaaaaaaaaaaaaaaaaaatattgtggggccggccatcgggccaggagaaaaggtttcaaaaaccattcggcgggggccgccgggcccagatatggttacggacaccctgccccaaagggggtcgaaagaaagaccggggcaagacaggcgcgggtttcccacaaaaaaaaaaaccgcggcggagaccgcgggtctgaaccaaaccccgagggggtcggccgccaacggggctctacacagcggggccacgagacgattaatcccacccgcggggaggt

SEQ ID NO: 351169 - DNA, 3912 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaaccattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351170 - DNA, 1433 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtgggtggcagggttggggatcctcaa

SEQ ID NO: 351171 - DNA, 2852 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgt

SEQ ID NO: 351172 - DNA, 2968 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcacccccttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351173 - DNA, 1489 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtaaaaaaaaaagaccaccacccacaaaacccttgggggggcgctgggcctcggaaaggtttttggacacccttggtggggggcggggcccaggggatggggaccgggcccaatgggtccca

SEQ ID NO: 351174 - DNA, 2480 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351175 - DNA, 2070 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351176 - DNA, 2215 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351177 - DNA, 1014 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactggctcagtcgaacggactgggtatcctctagag

SEQ ID NO: 351178 - DNA, 1331 bp, Homo sapiens
  misc_feature (1307)..(1307): n is a, c, g, or t
  misc_feature (1311)..(1311): n is a, c, g, or t
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgnccgnattccgggatcctctgacgc

SEQ ID NO: 351179 - DNA, 1362 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcacccccttttttttgtttttgtttttgtttttattttgtttcgtttttggggcttttctgtataaggaataacttgtccgatagggttaggatgagaccacttcctctttcgagggatcctcaagag

SEQ ID NO: 351180 - DNA, 3421 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351181 - DNA, 3379 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351182 - DNA, 1935 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351183 - DNA, 1896 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351184 - DNA, 1243 bp, Homo sapiens
  misc_feature (1200)..(1201): n is a, c, g, or t
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagagttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcacccccnntctctccaccctgccattcgccggcctgggtcagccacacac

SEQ ID NO: 351185 - DNA, 944 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtaaaaaaaaaagaccaccacccacaaaacccttgggggggcgctgggcctcggaaaggtttttggacacccttggtggggggcggggcccaggggatggggaccgggcccaatgggtccca

SEQ ID NO: 351186 - DNA, 671 bp, Homo sapiens
  misc_feature (478)..(478): n is a, c, g, or t
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggntgcataatcgccggttcacgagacccttccttgtactatccctatgaggtataattataacaagctccatctgcctacgacaaacagaccttaaatcgctccattgcatactcttcaatcagccacatagccctggtagtaacatccgttcttatcacatattatcgccaggtcacgagatgggtcccacgag

SEQ ID NO: 351187 - DNA, 554 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttcgacgcatctgttccgatcacgtctcaggaactcgccgttccgtgccatgtgagcatgccgcacagttcggagctttcagggagtcccctatcaatgagaatcgtcagatgtactggtgtgatgatcagaattg

SEQ ID NO: 351188 - DNA, 279 bp, Homo sapiens
ctctaattcggtgtgccttgtttttctttctcccttaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggtaagattgctctaccttttgtcttatttatgccaacacagtaatgtgtgtgttggggagagctgcagtg

SEQ ID NO: 351189 - DNA, 706 bp, Homo sapiens
ggcggtgatgggactaaacccagtatggtttcttcacctctctcctccttgcagtctccctgcccccctcatctccttccctctccccaatactgatgaaaccctgcatggtgtgttttccctagcaccactgcacagtttgtttacctagcctgtctgtgcttgtccctgcggcaactgttgcaatggctgcaaactaccttcattaagtagcctccaagggggatggtcgttgggcaagtgctgttgcttttctattcccacacccaaaaggcattcattctcttccaggcacccattctatttctaacccttacccttcatattctgccaatccccaggattgtgatgcaagccccatccctaccctctgttgtagtttgagtagtagagtcaattttgggaatcaggacctgcattttcaaattcgaatgtgcttgagccctggctctgttaaatcttctaatgccaacctcctgtttcctccttgcagttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggct

SEQ ID NO: 351190 - DNA, 292 bp, Homo sapiens
gcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagtttta

SEQ ID NO: 351191 - DNA, 317 bp, Homo sapiens
  misc_feature (279)..(279): n is a, c, g, or t
ggtttattctaaagaagattatagtgtggtaaacaggtttgaaagtcatggaggagactctctcccagtcccccccgaagggcgtgaccatcccgtaccggcccaagccgtccagctctccggtcatctttgcaggtggtcagttccagattttttaaggtggctacaacaatactatgaaatttcaactctttttttggacattcattctcttgagacattgagttttttaaaccctcctgtcattagaacatatctgggggtaatttccatttaatnaaatgggatccaaaaatgccagagtggctgggggtttg

SEQ ID NO: 351192 - DNA, 489 bp, Homo sapiens
tctagaggatacccagtccgttcgactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactggctcagtcgaacggactgggtatcctctagag

SEQ ID NO: 351193 - DNA, 494 bp, Homo sapiens
  misc_feature (7)..(8): n is a, c, g, or t
  misc_feature (10)..(11): n is a, c, g, or t
cgatccnncnncgacgtgttcaaacagatctgcgtggtcatgttggtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctctgccagcttctcaggtaccgagcctca

SEQ ID NO: 351194 - DNA, 2522 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351195 - DNA, 1615 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagccacataggaggtgccgagtcga

SEQ ID NO: 351196 - DNA, 2231 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttttggggttttttttttgtgggcctcatggaattttcctggttggctcagtggaaattgttaagaagtgtggaattttaatcactttccagttaagtccgtgtaagtgctcgggaattttctcaaaaaatttaaaacagtttggccgggaaaaaaaaaaaataaaaaaaaaaaaaaaaaaacaaacaacaaggggggcggcgcggcgggcaataagaaaaatctccaccccggaggacggccccagaagttcttaccacagacacccccgattttctttgaaccagaggggggcgccccatcaagagggagggcgagtcaatacaagcagaaaagagaacgcggagccaggcataacaaaccaagcggctcgtgctgtcggacaacgctgcgacccctggacaacccctggggcacaggaaccccaccacgccggcgcgggggcgggcaaccacataggcgggccaccccacccacagccagggaaattacgagacacagccgcaggggaataacataaccaggggagcggctgtcgacctgggccccacccggcgcctctagatgatcgcgtggccgccaaaagatgaggaccccgccaactgatcatggcagcaaatcataggcaagcggccgcggatctataacaacaacagacacacaccgcaccaaacgcaacacgcaagataacgcacacacaaatcacagcacacgacgagatcacacacaagtgcccagaaacagaaggacaagcaaccactacacacacca

SEQ ID NO: 351197 - DNA, 1883 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttgggggtataggggccgcaaagagaaattccgtggtgtggcagggcaagtggtaagagggggcaatatcatactttccaaggtaagttctggaatggcggagatttttccaagaacaattcaaaaaggttggggtggaaaaaaaaaaaagaaaaaaaaaagaaaaaaaaagaaaacgaacagaagacaccgacagggggccgagcaggacaacacaagcagaagacacaacaggaggaggggagcgcgaacaacaaacaagagaagggggggggggcggacggcgagagagaagagaaagcgtggggcgcgcccgatagaagtgagccggtcgcgaacgcagaggcacgagggggcgatcaaaaaaggggggggaggtgaacacagggtgatcgtatagcagccgcaaaccacggcgggga

SEQ ID NO: 351198 - DNA, 2483 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351199 - DNA, 1775 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgtaaaaaaaaaaaaaaaaaaaacaacaagaagaaaatgacacacgacacaacaacacaaaaaaaggggggcaccgaataaagtacccacgcgagggcccaaaaaacagaaccagattcgtgaacaagtggcccaaaagagcgccgaaaaagcacaccacggaccacatgtaaaacagagcggacgggaaacaaccccacccgcggaccctctgggagaaagcccaccaccggggggcgaccacgatgcgccccacccccccagaaataaacccccgaggaaacacaacctcacgcgtacaagggtaacacaagcgaatatcgcaggagaaaatgtcacggaaatgatatgaatagcgcacaccgaagaa

SEQ ID NO: 351200 - DNA, 3966 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351201 - DNA, 1369 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgt

SEQ ID NO: 351202 - DNA, 3799 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351203 - DNA, 2468 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatctctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351204 - DNA, 2973 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgttttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactgattgcataccttgaggcacctcctccagtattattttgttcattttgttttcctttgttaacattggtgagaatgaaactattgtgagcttgttaccgtttcctttttactactttgggggataactgggtgggggtgggggagtggtaacccttgtttaggtttaggccatttcagctgagtgcctgtttcagggtctgacttgaattctttatctagagccacagttttctcttctttcttgtttgttacttttctttgtagctttattctgccttgcaatataacaatgtgttaggctctgtgttaatgaataaaagctgcttcgttaacttttttttttttttttaagaattatttaatggttaagctatcagcaggccttcttggccatatttgtgtttctagctgtaataaagttggcgcagtaagaaccttagtacactgtgtgctgtgaagggtaaagggttgggggcttgtgacttgtggctattcagctaggaagcctgtataactgacatgggctttttgaatcccaagtgaattttatagtcgtttgtcaatatttccacaaagagataacgagtctgtggcagtttagatcctgaaggtcctctgtaattggcaacaagcttcactagtgaggaagtttatctgacttctcagatggccttaccttgccagcagcagctaacaaggtgttcatcccaggattcctctggtgaatggttaccatgaggatctcttccaagtcatacattcaaagaacatacttctttacccagaatgaaggggaggggcaaagtgggataagtctaataaaattaggcagcttctgtctgcattcctctgaattagcattatgcctctttctgtgacattaggtatatctcagccaacccgtgacattatccacaacttgacatgatgccatccactagtcctaaaccaactctgtcaaccaagtttctttacccttttttctattcctggccgtatcctttctgctccccaccagcactatcaggagtaggaagtgacatgcttagatttggaaggaaccttaaggatcaactaatctgtaacacattgatcccctcattttacagattaaaaaatagaggccctaagataatttaaattcataggttatgagtgactagccaggactaacaacttaagctttacttttactcaatcgtactaacctccctgaaatcttgttcattttcttatactaagatgggcacaggcctctcataaaacagtagaaatgttcttagtatggtggtataaggcctctgatagccttccattcaacgagagtacacgttgccacagtgctgaaagtgtaatgctcttcccagggcattagagaactcagtgtagagatagtttccctgatgaccttttcccagcatcaccattggctgacaaaaaaaaa

SEQ ID NO: 351205 - DNA, 1301 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttctccacatctcctcatgatgatgccaccatcaatgttcccaca

SEQ ID NO: 351206 - DNA, 2441 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatctccagacccactgagacacggatctggctatgaatatgcttgcggtcttccgtgccttcgctgtacactggaatcgctacgacagatacaggattcacgcc

SEQ ID NO: 351207 - DNA, 2232 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaaccattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactcttccccttcttctcttctcaggatcctctagagca

SEQ ID NO: 351208 - DNA, 1975 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtattgaagctcatggtgctagctctct

SEQ ID NO: 351209 - DNA, 863 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgt

SEQ ID NO: 351210 - DNA, 1977 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351211 - DNA, 1297 bp, Homo sapiens
attcggcacaggcctcgcgtatatttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaataggctgatatttctttgagcccatcctgactgctgcccccttgatctgatcagcaccccctttctctccaccagcaattcacaggcttgggtagagaccatccatttgtgccaaattgtgtagtggtttttttggttttggttttgtgtttattttggttcggttttg

SEQ ID NO: 351212 - DNA, 1938 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaac

SEQ ID NO: 351213 - DNA, 824 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgt

SEQ ID NO: 351214 - DNA, 873 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttcaaatacgctgggaatttcaggtctccacccttttagtcccaccggatgcaccaaaccggtaatccttcgggtaggtggaaccgcaccactaaaggtgaaaggccggtgcagggatatgacaaaggacacaaaaaaaggaacgacag

SEQ ID NO: 351215 - DNA, 693 bp, Homo sapiens
attcggcacaggcctcgcgtatatttcccctcagtcgcctcgcgcctgcagtttttggctttcacccccaaccagtgaccaaagacttgaccactcaactgagcgggccatcactattgctggcattccacaatccatcattgagtgtgtcaaacagatctgcgtggtcatgttggagtcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaacactacacaatttggcacaaatggatggtctctacccaagcctgtgaattgctggtggagagacagggggtgctgatcagatcaagggggcaccaatcaggatgggctcc

SEQ ID NO: 351216 - DNA, 1875 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttg

SEQ ID NO: 351217 - DNA, 2267 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351218 - DNA, 1958 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351219 - DNA, 1717 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcagctcgcccctgagttctgcaaactcaggggcgagctgctgtttgtccactgcatttatgttggctccagcctgcagcagcacatggcagatctccacggagcccctctcgggcggctgcatgcatggggcgtgcgtcctctgctctgcatgtcgctctcgcgaatatgagctccatcctgcctatcagcctcagactcactcatt

SEQ ID NO: 351220 - DNA, 1370 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351221 - DNA, 391 bp, Homo sapiens
ggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttga

SEQ ID NO: 351222 - DNA, 2300 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351223 - DNA, 2374 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacgatgggggaatggaagcgctgttgctgtcatgcaagtgcttcatctcgctgggcgctgcccctacgtctccccaggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351224 - DNA, 1827 bp, Homo sapiens
gcctccgataagggcctgaaggggctgtcgcgctcctggcggtgtgataaggagggcggggggaggccgcgggaaggcgtcggggtttgaggtccccgcctggcgacccgggatcggggcaggaaaggcggctgggcggggagagggcggggcggggcgtctggcttggccacgcccaccgtcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgatcgtgggtgtggctgggcgcagcgttctgaggggatgtggggtctgggaggtgtctcgaggtgagagctccaagtcacgggaagtttaagtcagcctcagtttccacatccataaaatgggacgacttccttacccacagctacacg

SEQ ID NO: 351225 - DNA, 508 bp, Homo sapiens
ggtggtcctgagaagcacctactaaataaacctgggctaaggaatatggcttggcactgtttgtggctgaccctgtctccctcttcccgccaggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggca

SEQ ID NO: 351226 - DNA, 3038 bp, Homo sapiens
tgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcat

SEQ ID NO: 351227 - DNA, 493 bp, Homo sapiens
ttccccagatttccagtttttgcctggtaagagacaggaaccacatacaaaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggaaaaaaaaaaaaccagtatgtgaaacaaagtttaagagtaaaagaaaagcttctagcgactgagatgtttgaaagagtcacctttggatcaagatcatctatggatctaaatgaaat

SEQ ID NO: 351228 - DNA, 2277 bp, Homo sapiens
cttattttccttctttagtggaccgtagttagaagggtgctggttataagttcctaaatcattgtaatttccacttccataatttcctcctccatagttgtcataaccacctccgtggcccccaccctggttgccatatccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcat

SEQ ID NO: 351229 - DNA, 446 bp, Homo sapiens
gttgccaggaaatgtttctctaaccctttcaaaagtgtttgtaaaccaagttcaaaggaaaatagacagaatgatttccaaaattgcaaaccacgccatgacccatatacgccaagtaagattttaaaaataatttgaattttctgtttttactgtcaaaatgttttttgtgtgtgaatttgaagtttaaattttgttttaaaagttttaggtgaaagtatacattattcttgagatatataatctgacataagagataatgttgaagtcaaataacaatatagtttgggaattatttcatatgtaaatgaataattctaagaatacagtaataaaaatactgtacatgtgttgaaggaaacatatctaaattgtatgtgtatacattacacatacatgtgtataattttgaataaaatctgactttttagtaaggagagaaatta

SEQ ID NO: 351230 - DNA, 3084 bp, Homo sapiens
tgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagtgcaaacttggatgaggaggcacaggctggtaccagttcactacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcat

SEQ ID NO: 351231 - DNA, 822 bp, Homo sapiens
ttgatggggttgtttttttcttgtaaatttgtttgagttcattgtagattgtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcat

SEQ ID NO: 351232 - DNA, 899 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351233 - DNA, 332 bp, Homo sapiens
  misc_feature (276)..(276): n is a, c, g, or t
ggctgacttagcaccacccgattagcgagcttcatcaaagagacacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactccaanaggcgctttggctaagttgatggaagcgtcgcgcataggatcctctagagcacctg

SEQ ID NO: 351234 - DNA, 932 bp, Homo sapiens
cctcctggattcatgccagccatttcggaattttagaccaaccgggggcacttctgcaatcacctgccccccagtaacaaatgtgccccggaaggacttcgtgcaatctcgtttcactgagagccccaagtgtccccgagcgcgggatccttgggcccgaacattgattaggccccaaagattcgccaatcggctatatggccggcgtttgggcattttggggtgggcaggcacgagccgagtaccctgtgactctcgtagcgtgcccgaggccttcatggcgtgctttccgcggtttgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351235 - DNA, 1223 bp, Homo sapiens
caccaccccacaccacccaccccccccccaactaggctcagtgtcaaagccggtgttacgaggcagtactatacgtctagtacgagctggtgcgagatgcgaaagaagaggcaggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaacacgcgacaccacaacaacacacaagcaagaacaactacacaaatagaataacgatacaatacatcaaacaacccaaataaagaagcagggggagggacgcgagaaacgacagacggaagcagagaagatcagacgtgcgggactgagccgcggaagtgcgatgacgagaagacaagagagagagtgaccacaaacacagcatgaggaagcagaagagagcggagggcaggagcaaaagagaaaaagagagatgacatacggactcgacg

SEQ ID NO: 351236 - DNA, 876 bp, Homo sapiens
  misc_feature (31)..(31): n is a, c, g, or t
  misc_feature (831)..(831): n is a, c, g, or t
  misc_feature (841)..(841): n is a, c, g, or t
  misc_feature (848)..(848): n is a, c, g, or t
  misc_feature (850)..(850): n is a, c, g, or t
  misc_feature (855)..(858): n is a, c, g, or t
taacgctaggtacgagccggtgtaaatcggncgaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaaaaaaaaaaacccgggcattggggggggaaaaggttgaagggcctggtagggtccgnccatttgganagggaangngcccnnnngacgtaatcgaagcagac

SEQ ID NO: 351237 - DNA, 944 bp, Homo sapiens
  misc_feature (899)..(899): n is a, c, g, or t
  misc_feature (909)..(909): n is a, c, g, or t
  misc_feature (916)..(916): n is a, c, g, or t
  misc_feature (918)..(918): n is a, c, g, or t
  misc_feature (923)..(926): n is a, c, g, or t
accaacaaaccgccaaacaattgcatgatgggccgggtatacggacgaggcccgttgagaaaatgctatgaagtttggcatggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcattatgaatattcaatttcttcaaaaaaaaaaaacccgggcattggggggggaaaaggttgaagggcctggtagggtccgnccatttgganagggaangngcccnnnngacgtaatcgaagcagac

SEQ ID NO: 351238 - DNA, 952 bp, Homo sapiens
aacgataggcaggtagcgaggctgggtgggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcacttccaaaaaaaaaaaaaacccgagctttattccgggcggcaaaaggtatgatggcatgcctagctgtcctgcccgtttcttgccagtgcgaatcgcggccctaaggggcggtaatcgagcgcggtttgtaaagaagggtcacccctcagcacccctctacaaccccccaccaccctaccagccca

SEQ ID NO: 351239 - DNA, 323 bp, Homo sapiens
cgcggccgcgcgaccggctgcgagagacgacagaaggggacgtctagtccacaggagactgcaccatgtcgcccacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351240 - DNA, 1024 bp, Homo sapiens
  misc_feature (979)..(979): n is a, c, g, or t
  misc_feature (989)..(989): n is a, c, g, or t
  misc_feature (996)..(996): n is a, c, g, or t
  misc_feature (998)..(998): n is a, c, g, or t
  misc_feature (1003)..(1006): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcattatgaatattcaatttcttcaaaaaaaaaaaacccgggcattggggggggaaaaggttgaagggcctggtagggtccgnccatttgganagggaangngcccnnnngacgtaatcgaagcagac

SEQ ID NO: 351241 - DNA, 1172 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaacacgcgacaccacaacaacacacaagcaagaacaactacacaaatagaataacgatacaatacatcaaacaacccaaataaagaagcagggggagggacgcgagaaacgacagacggaagcagagaagatcagacgtgcgggactgagccgcggaagtgcgatgacgagaagacaagagagagagtgaccacaaacacagcatgaggaagcagaagagagcggagggcaggagcaaaagagaaaaagagagatgacatacggactcgacg

SEQ ID NO: 351242 - DNA, 1300 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcataatacaaattttccttcaaacagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgcatatcaagttttgggaaagttctttggactgaaaccaagccaggattttatgatgaaccagtcatgagctcat

SEQ ID NO: 351243 - DNA, 939 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcattgtattatttcaattatttttgtcgacgcggccgcgaat

SEQ ID NO: 351244 - DNA, 1471 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaatactgagcccaagaagccgtgaagcgtgtcgccagagcccgacgaaggcccatggaaccacatggctggaactaatgggggcgcgaggagcacacctgtcacgtcggctcgggggcgaaccttttgacccctgccaatcacttgatatagacccccggacgagcccaaacaagtcagggggactatgatagggactcagctggggccccgtcatcatataaatgcagcttgtggcgtcatagacacgtccttcaaacaccgagcacttcattaacagacagcctatcattattctaggtggagcgtccgtaaccatgtccatcatgtgcctgtcccacaatgagtaaagcctacgctgcttcggtgcataaaatgggtgcaattcaccccagagttggatcccagtcggtctcaagcctccgtctgagtccttgtgcacagcaggccctagtaaattttatcctcacgcgagtcatgtcatgttgcagcagatcatttgtcaccggcacgttactgttatatcaaaaccgatcatcccgccctgacaatttctccgttaatatcaggata

SEQ ID NO: 351245 - DNA, 1064 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggtgtttgtgtgcagatgatgtaaaagaatatttgctatctgagagatggtgatgacattttaaaccaccaagatcgctgatgcaccaacacccttcctagtggccccagacatgaacttgacatggaatttgagcctcactcggtgtcaccctttacttctcagggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351246 - DNA, 1274 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgctaaagaacttgccactaaactgggttaaatgtacactgttgagttttctgtacataaaaataattgaaataatacaaattttccttcataatacaaattttccttcaaacagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgcatatcaagttttgggaaagttctttggactgaaaccaagccaggattttatgatgaaccagtcatgagctcat

SEQ ID NO: 351247 - DNA, 1490 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcataatacaaattttccttcaaacagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgcatatcaagttttgggaaagttctttggactgaaaccaagccaggattttatgatgaaccagtcatgagctcat

SEQ ID NO: 351248 - DNA, 1764 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcataatacaaattttccttcaaacagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgcatatcaagttttgggaaagttctttggactgaaaccaagccaggattttatgatgaaccagtcatgagctcat

SEQ ID NO: 351249 - DNA, 1363 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351250 - DNA, 724 bp, Homo sapiens
  misc_feature (668)..(668): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactccaanaggcgctttggctaagttgatggaagcgtcgcgcataggatcctctagagcacctg

SEQ ID NO: 351251 - DNA, 979 bp, Homo sapiens
  misc_feature (756)..(756): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (773)..(773): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggtgcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaanaanacccanaanacaanaaatctgaggccctttcacctccaccgacatgacaagaacaaaagcacgctaacagcacacctgcgaccacgtggcacataggcggtatcctttagaccacaatttcttgaaacaaaggaggaaaatcttgcagcgttcccccattgaagagcacgatataaacccgcaaataggcccggtatcacggtagaacaagatgtatcaa

SEQ ID NO: 351252 - DNA, 813 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351253 - DNA, 790 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351254 - DNA, 1017 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgatgaacaatggtcctacatgaacttcttgtgcattggcatcagggagcagtccagacccaaatagagatcctcacccgtcgtttgtgaaactggccccgtctatagtcaggttgcagtcggcagacgagaccatccgtctatatagctggcgtgagatagtgccctcctggcgatttagagccatgttcacccagggcccttggtaaccgacgagagacagcgtagctcaggctggcttgaaaggctgggctccacagaggttaccatgacccaaggagaccacaagcgagaggagcaagcacagcgagcagcacttgttggggcccgtggcgcgagatacatgaaaggctgggtgggccaaagggggacgtgcccccagactgaaaggagcacctacctgggtcccttcgatgcaggacgttaaccacctgtcacctaccgttgcgtggatgaagccgaagagaaagctcagtcgtggtgagtgagttgcacacgacgatggattcccaatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351255 - DNA, 236 bp, Homo sapiens
  misc_feature (176)..(176): n is a, c, g, or t
  misc_feature (236)..(236): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattgcaaaggcatacccnccccaaaagagaaccctactcccttttgttggaaataggcccctttaattaaaagttcan

SEQ ID NO: 351256 - DNA, 1308 bp, Homo sapiens
  misc_feature (916)..(916): n is a, c, g, or t
  misc_feature (919)..(919): n is a, c, g, or t
  misc_feature (926)..(926): n is a, c, g, or t
  misc_feature (929)..(929): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaaaacacaacacacancanaacaaanaanaccagagcacaaacacagggcggacaaagacgaacagacgcacatgcacacagggtcacacacccgtttgaaaaagggaacacacccgggcccaataggagacgatacgaagacacgggaacgctataacaaacgagacaacccagagaacaacgagagagcaccacaaccagaggagggacaacatgaaacaaaaaaaaatgcgaaagaacaaaacaatgcgacaaaacaaaaaaatacctctagaaaaaacacaagacaacaatcagccttatatacaactagaccacaaaacagagcaaagacagacaacatcaccatctcttacgaatctatacatcactaacaacaatgcaatcccagcaacacacacaacacc

SEQ ID NO: 351257 - DNA, 941 bp, Homo sapiens
gctggatgccttagaggaggagaagggcacgggagagaacgtggctccggccccagactgtcttgatgaaacacgcgaggctatttaaagtggtctaatctccctgattttggacgatacagatggacctactgaattttggcattggacaggacatcctaggccactactgaagacctcaccgcgcttctgtggaaagtaggtccgccgactatattcatgggttgtcacgtcagtgggagacgacgccctcctcttttaggctgggttgaaaagtgcctcctgggatttagatcaggtcagccctatgtgcccgtagtgcacccgacaatagccagctagctcgacgcctgctgtaaaggctggactcgagcaaatgatacacgtactcgatgagatcgacagtccgtaggcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351258 - DNA, 889 bp, Homo sapiens
tgttttcccagtcacgccgttgtgttttcccgatgccgacgttgtgtatttcccagtcacagagttgtggttctggcagctacggaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351259 - DNA, 989 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcactggcctacaatattgaatatcaaatttcctcaaaaaaaaaaaacaactccggcacctaatccaggggggaaaaaggtaccgaaggcaca

SEQ ID NO: 351260 - DNA, 1132 bp, Homo sapiens
  misc_feature (913)..(914): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaacaaacacaatcanncaaaaacacctccgaagcgcactccaattgctcagaggttggcggacaacaggcggtcacacacacacatgcggcccacgtcggtccattagccgggttcaccctgaacccccaggttatctgtcgtcacccaacgtggccacaaaatctcgccgggtaccccataattggagacccggcattacattcggaacacgccagggttaacccggcttcag

SEQ ID NO: 351261 - DNA, 1411 bp, Homo sapiens
  misc_feature (1408)..(1408): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaacaaaaaaatacgaaaaacccggagggcgtctgatcgtgcgggcgtggggcagaaagggcggctgtgaactcggcgcactgtggcgcaagctggaatgcctgacgccaggttgcttgtgacccccggggttgcatctgcagagacccctattagggagcgcggatagatggcagaacagcgcaggtaagcctgcatatgcaccgccaaacagaagaaaaaaaaggatatcaacaaattacaactaccgagagatcgtaacccacctccctacataacacaccatacaataaaaacgatcgtaaacctacaaatccattaacccatatccgcaccacgacaactattaccaacatactataatataacaccaacactcacacagtatgttaaaccatccataaatacaaacaacaatctaaaaccatatagaatacagataaaaacaacgacgaaaatattaagaatactaaaaaaaaaaaaaaaaaaaaaaaaaaaacaaaaaaaaanaac

SEQ ID NO: 351262 - DNA, 1001 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcacaaaaaccccaaagaaacgcgggcaatatgtcgggggggacacggaatacaagggcaggcaagcgttacggcccctccgtgacaaggcagatcgcggcccta

SEQ ID NO: 351263 - DNA, 956 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcatgcgctcatacgtcctccaccgactcctgcgcccataaaaacacctcctataaagcc

SEQ ID NO: 351264 - DNA, 1173 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351265 - DNA, 1176 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351266 - DNA, 1074 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaactggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351267 - DNA, 1218 bp, Homo sapiens
  misc_feature (1215)..(1215): n is a, c, g, or t
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaaaaaaaaaaaaaaaaaaaaaaaaaaacaaaaaaaaanaac

SEQ ID NO: 351268 - DNA, 1363 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351269 - DNA, 819 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351270 - DNA, 1637 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351271 - DNA, 605 bp, Homo sapiens
aattcgcggccgcgtcgacgctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaaggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 351272 - DNA, 924 bp, Homo sapiens
aggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaattttaaaaatgtaaaaaacaatgcctgtactgaagtaccaccaccgatttaaatgggctgagttgggggaggcatggagtaaatggcaggggatcct

SEQ ID NO: 351273 - DNA, 468 bp, Homo sapiens
agaattccacgttacgagctgctgctcaaggagtacatcagaaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttggtaagcctgtctctactaaaaatacaaaattagccgggtgtggtggtgtacacctgtaatcccagctactcgggaggctgaggagggagaatcgcttgaacccaggaggtggaggttgcagtgagcccagatcaccccactgtactccagcccaggcaacaaaagcaaaactccatctca

SEQ ID NO: 351274 - DNA, 870 bp, Homo sapiens
agaattccacgttacgagctgctgctcaaggagtacatcagaaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttggtaagcttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaattttaaaaatgtaaaaaacaatgcctgtactgaagtaccaccaccgatttaaatgggctgagttgggggaggcatggagtaaatggcaggggatcct

SEQ ID NO: 351275 - DNA, 894 bp, Homo sapiens
gctgtagtttatgccttcataaagctctttctgtttgtttcagttctgggacatggaaacagttgcttattgttttctgttaggttcttggtattttatgaatttttgagtttagcacttactatgttaagttgcagatttttttctcattttgtcactttttttttaatctgtgttgcagaagttttttgttgctaattgaatgtttatgtagtctggattttgcctgtagttagaaagagctttcctattcctggattattcaaagtagattaggttgtattgaatagtacacctttcctccactgatttgagaataccttctttatcttatactaaatttccacatgtatttgagtttgcttctagattttctgttctgttccagtggttggatatttcttcatacacgtctatcatactgttttgactatagaggcttttcagtgtcatttaatatctgtgatggcaatccctactcaaagctctttgttttcagtgttcctgtattgctcttttgttaatcccttaatataaaagtaaataataacccagttggcatattattttgatgacattaaattggggagaatagatactgtgatttttgaagcttcctacaaatatgatatgcttttcatttgtgcaagtactttagtataatgttaactggtggtggtaatggaggaaattctgtcatgttccttacttttagtttcctctagcgctttctatttttttattttttttcagatggagtcttgctctgtcttctatccaggctgaggcaggaggatcacttgaacccagtagttcaaggctgcagtgagctatggttacaccactgcactccagcctgggtgacagagcaagatgccatctcttaaaaaaaaa

SEQ ID NO: 351276 - DNA, 426 bp, Homo sapiens
catggaaaaagagtatttggctttttaaaccaatcgagtcacatgcatgctttcccccttccacgttggactacatcaatatttagtgttagtatttttataaatagataaatattgttcgcaaattttatttgctgtctattgctgtgtaacaaattcctccaaaattattggctttaaacaacatttattatcccatagtttctatgagttgagaatctaagcatggcttagctgggtccactagctcggggtctctcacaaggccacagatcaaggtgttggtcagtggtttgtgcccttagtcccagctacttgggaggctgaggcaggaggatcacttgaacccagtagttcaaggctgcagtgagctatggttacaccactgcactccagcctgggtgacagagcaagatgccatctctt

SEQ ID NO: 351277 - DNA, 149 bp, Homo sapiens
ggtgaacggcaccacctctcacctggctgctcaggatcacaggagtcactccccacttctccctcttcctccctcccccaacatccaatcagttgatcaagtcctccctgcatttacctataaacatctctggagcctgttcctcatct

SEQ ID NO: 351278 - DNA, 584 bp, Homo sapiens
ttcggtaaagaaaaataatgctttatattatgttgctgcataatttggacatatattgggagaaagcagagaggataatagcaaaaaaaaggaccaacctaagattgcagtggttcatggactcagagctaaaccctgtaaagtgagcctgcaaatacttaagtcacttacttaactctgattattttaaataacattagtggttactttggttatgttttcccaacttcttgtgaccttctggagacagagtgttgagaaattaacttgcaaaaaatgaaatgtgtaaattaggttgagggtttcttttctttttttaaaaaaacccacagaatatcctttttctttttaaatttgtaggttgcaataaaaataattgataaaacacgattagattcaagcaatttggagaaaaccaggtaaggggtcagcttgcctttctctgctaatcctggcaaatgtgttatattttatttccaacagcataagtctgcaatttctgaaggtggcttcccttttggggagtgtgtggaagttgggcatttggttgtataaggtaaatagattgatttttataggctgtg

SEQ ID NO: 351279 - DNA, 871 bp, Homo sapiens
acatgcggcgcggccccggaggcagcagcagcggcggcggcagccggagcagtaggcacccgagcagcgccagcggccgagcgggcggcttcctggcctgggcgctccggtggcggcggaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttgttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagtttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagg

SEQ ID NO: 351280 - DNA, 4305 bp, Homo sapiens
cggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcagatgaagtgtgtggctatgtatgcatgtaacttggtttctttgaaaacccaattatatttgtattgtggtgtttcttgt

SEQ ID NO: 351281 - DNA, 837 bp, Homo sapiens
cggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcagtaagtacctgctgtggaatctcgtggaaaagattgtaatattagaccggttgctggtcttacaaaggtacaatccaaagattgttaaatcctatttcaaaacacctaagcgaaagaacacatctggatatttcattatttatactgtgtatatttgtgtgtggatgcttttattcttaaacagtgagaacgttttgagttgatattattaataggccattttaccagtacgggttataccaagtggtaacacatgggtctttaaacagaccccaggtcagaaagtctggactttacctgcctttttttaaattcagttca

SEQ ID NO: 351282 - DNA, 4197 bp, Homo sapiens
ggcctagagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcagatgaagtgtgtggctatgtatgcatgtaacttggtttctttgaaaacccaattatatttgtattgtggtgtttcttgt

SEQ ID NO: 351283 - DNA, 4110 bp, Homo sapiens
cggctacgtcacggtggcaggttctaagcgctgctgggcaccgtaaggccgccgtgtgtaccttccagtagctacgggctggtggaagcgctgctcacagtcagtgtcgaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcagatgaagtgtgtggctatgtatgcatgtaacttggtttctttgaaaacccaattatatttgtattgtggtgtttcttgt

SEQ ID NO: 351284 - DNA, 739 bp, Homo sapiens
tggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcagtaagtacctgctgtggaatctcgtggaaaagattgtaatattagaccggttgctggtcttacaaaggtacaatccaaagattgttaaatcctatttcaaaacacgctaggtgtgtgattaagcttcataattttctagaatgttcagaaaaaataagctaagcgaaagaacacatctggatatttcattatttatactgtgtatatttgtgtgtggatgcttttattcttaaacagtgagaacgttttgagttgatattattaataggccattttaccagtacgggttataccaagtggtaaca

SEQ ID NO: 351285 - DNA, 4517 bp, Homo sapiens
cggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcagatgaagtgtgtggctatgtatgcatgtaacttggtttctttgaaaacccaattatatttgtattgtggtgtttcttgt

SEQ ID NO: 351286 - DNA, 4463 bp, Homo sapiens
cggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacacagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccaaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcagatgaagtgtgtggctatgtatgcatgtaacttggtttctttgaaaacccaattatatttgtattgtggtgtttcttgt

SEQ ID NO: 351287 - DNA, 2959 bp, Homo sapiens
cggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggctgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacacagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagaagcgtatgttttttattatgctgtattttccttttattttttaattattgtttatattttcaattcaaaaatgtacaaaataaa

SEQ ID NO: 351288 - DNA, 7019 bp, Homo sapiens
  misc_feature (1979)..(1979): n is a, c, g, or t
  misc_feature (2021)..(2021): n is a, c, g, or t
  misc_feature (2024)..(2024): n is a, c, g, or t
  misc_feature (2075)..(2075): n is a, c, g, or t
  misc_feature (2137)..(2138): n is a, c, g, or t
  misc_feature (2327)..(2327): n is a, c, g, or t
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaaggtgagtggcccagtggggacaggtggtgctgacgctctggggcaggtagggttgctggagatgctggtgagatggtgggatgcaggtcgtgcagtgaattcctggaggacccctgagtctgggtgatcctgtgtgtcaagggataagcccggggcaaggagggcctggagtacctcagagacccagtgtcatcaaaggaataaacacacccccacctcccaggatgtcagaaccagagagggtttccagagcctcagcngatggcaaacacaggctgcttgtttgtagctgggccagaggnagngcctccaggtggctccaggcttctgggagaacaaggccccacaccacactncttcccccagcacccagtagagtcctctgcagagtcctttctgcatgccaggcgctgagctnntggctttacctgggtcatacccccccagtgagatgggcacactaacttttatggccgagggcaccagcccacagagacggagtgtcttgcccagggtcccagagaagcaaaggggctcagcctctgaaccctggcctggatccacagctgcccgtctctgccagcctctgcagctgtgttttcttttgnctggaaacgggatagatgtgacgttggggagggggtgctgctgcttctggaagacgtggcgtcacagagccttgtgcccgtgggccatcttctccgcccgtccctcttctgagtcctggtgttccccgcagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcgagtcctgggctgtcccccaccccaccccgctggtcctccaccccactgctgcctctcctgaggcttcccaggtctcggccccagatctctggctcgtggttctggcttggggcctgggaagctgtctgtgcctagagcctctgttggttgggatggaagctgtgagtccagggaacctctgaggagcctggtggccctgctccacccacgggccgtgctgtcaccagccacaaggtggcgccaggagtctctcccagctctagccattcctgctgggccggggattcccacagggctgtgctccagaactggctcccagagccgaggatgatttgaatgggcggctgcacatctccaggtctgtggggtgggaggtcagttgggtgggaacagttcaactgtactcctacttccagcttcttccttgaaagctgcaggcagggctcgcccgtctgtcggtcagacgtggagatggcatttgtggggaaggcctccctccagcccctcctctggagactgtggactcgtggtggggtggggtgtcgaggagaccaaatcccacgagcccggggagcaagctctgcgtcctttctttttcgtgacagctcaaacctggcaaagaagataagcttttcaggaaaaaggtaccatcttcccctccctcctgtgccccaggcctgagcggttagagctgcaccgcagctccctgggccacagtcccgtggcaggggggcgggaggccttgggcgggcgcagccctgagccccagaggctgacgcgtctccgctctcgccctcagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtgagttgccaggctgggggtttctgtgggggtggggtgagcgagctagactgttggatctgcttttaccctcagaccccagctgttccccaaaggacatagggatgagtctctgctgccatgttctcagtttgcttcaggcacagaggggatctgggaggaggcaggggctcctgtgcacacgtgagactcgctcctggggctccgcgtgcgtctctctgctttcctgttgactcgctcatggggctctgcgtgtgtctcactgctttcttattgactcgctcatggggctctgcgtgcatctcacttcttttctgttgacttgcccctcgttggtttcaagcctccactgccatcgggatcagtgtggttgtgcaaaggcttccaggatggcacctccccctggactgggctggactgcctaggtccgtgcttctcgccaagccatggggatcggagatgctgcgcagcctctgcactggttggctgatgactactgggtggaatgtgggcatagtgtttctaggtcttttagtttttcaagagaatctgaaaatctaagttttgatgtggagtctgatttttcactgttggaattatgattttgggaggaagcagtttataactaaatgaaatctgagtgttctgtctggctggtgggccttttagagtgtcatgtcagcatgaccaggcctcctcggtcagattgacgggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351289 - DNA, 3571 bp, Homo sapiens
tcgcggcagcgggagcccgagcccgagcccgagcccgagccagggcgagccgagcctgctccgggcgggcggcggcggcggcgccgtctccagccatgtcagcgcgcgcgagcctgggcccaccatgagccatggccatgtccgtgagcgccgaggacgacgactatgaatcggagccggaccagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351290 - DNA, 4628 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtattctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351291 - DNA, 2076 bp, Homo sapiens
ttgatagagagtctcgctctgttgcccagcctggagtgcagtgcagtggcacgatcttggctcactgcaacctccacctgggtgacaaaagcgagactctgtctcaaaaaaaaaaagcacaaagggtgtgtctgcagatgagggtgtgatgaagtctgaattctgcttttgctagaagggcatgttggtctggtgtctaggctgctggcacacggtcagtcctggagttagggccaaacagctgtccctcatgctgtgaattgctccaaagcactgcggcctgcaaaagcaaaaatgatcccaagatgcccttagggatgttctttctgtgacccagcaatgcccctctgggaatttatctgaagggaggaggcaaataaatgcacagtaatagacatagagcagtactcatcaacaacatattagatgagaaaagcaagctacttgacatggtgtgtgaacctatcattgtaaaagcacatagaactacttacatgagcatacgcacgtatagaggcagctgtgtggtaaatcagaagtgattttcacgtggttatctgaatgcttttgaggcatatattaacctttatacctggcgggtgagacccttccccgtttgaagaagagagattttaagcaaataacattttatttagtgcagcacagcagggactggaatatgtagagctctgacctgtccccactgctgagtgcctgggtctggcggcgggggggcttctggctcctggccttcacacctcacattactatttcttctctgcagaactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351292 - DNA, 2432 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351293 - DNA, 2673 bp, Homo sapiens
tcgcggcagcgggagcccgagcccgagcccgagcccgagccagggcgagccgagcctgctccgggcgggcggcggcggcggcgccgtctccagccatgtcagcgcgcgcgagcctgggcccaccatgagccatggccatgtccgtgagcgccgaggacgacgactatgaatcggagccggaccagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtcagaggagatcaaagggaatcatgaatagttggaacagaacaggaattcaagcttgaaagaaaaccattgcccagccagcagcctacgacctctgaaagctctgaggatgaagattcctgcatctaccactgtgacatcatctttgaagatgaagaatccatccagaagataaatccttccaagcctggactccatctacctggctctcctttagtatgtttcatcttcctgtactttctcataaatttcagaaatttaaaaa

SEQ ID NO: 351294 - DNA, 415 bp, Homo sapiens
aggttgcagtgagccaagagtgcaccattgcactccagcctgggtgacaaaagcgagactctgtctcaaaaaaaaaaagcacaaagggtgtgtctgcagatgagggtgtgatgaagtctgaattctgcttttgctagaagggcatgttggtctggtgtctaggctgctggcacacggtcagtcctggagttagggccaaacagctgtccctcatgctgtgaattgctccaaagcactgcggcctgcaaaagcaaaaatgatcccaagatgcccttagggatgttctttctgtgacccagcaatgcccctctgggaatttatctgaagggaggaggcaaataaatgcacagtaatagacatagagcagtactcatcaacaacatattagatgagaaaagcaagctacttgacatgg

SEQ ID NO: 351295 - DNA, 4737 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351296 - DNA, 4835 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgcttctttgttggaagggtctttgggctccagttttggggaatatgtgaaccacaagccaggaagaatgctggctgggcatgaatgagcctccaaagagggcccaaattagtacccaaagacaactcagaaaaggagccagctgggcctccaggtctcacttcacaccaagtgctgccttaccaccgacagactgcaataaggtcactgatcagtgcctgtccttcttcaaacgctgtggaaacatctgtcatattgacctgaggtactgcaagcaagtcaccaaggaaggctgtgagcagttcatagccgagatgtcttctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtccaaacaa

SEQ ID NO: 351297 - DNA, 3393 bp, Homo sapiens
tcgcggcagcgggagcccgagcccgagcccgagcccgagccagggcgagccgagcctgctccgggcgggcggcggcggcggcgccgtctccagccatgtcagcgcgcgcgagcctgggcccaccatgagccatggccatgtccgtgagcgccgaggacgacgactatgaatcggagccggaccagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtcttctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaacca

SEQ ID NO: 351298 - DNA, 1609 bp, Homo sapiens
  misc_feature (1555)..(1555): n is a, c, g, or t
  misc_feature (1568)..(1568): n is a, c, g, or t
  misc_feature (1604)..(1604): n is a, c, g, or t
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccagcactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcaaaaaaaaaaaaaaanttctcggcgaagnttttcctttgtagggtaatttgcttggcttgcgtgntttac

SEQ ID NO: 351299 - DNA, 1651 bp, Homo sapiens
  misc_feature (1597)..(1597): n is a, c, g, or t
  misc_feature (1610)..(1610): n is a, c, g, or t
  misc_feature (1646)..(1646): n is a, c, g, or t
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaaatgagtcttcttcattggggaactgtggagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccagcactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcaaaaaaaaaaaaaaanttctcggcgaagnttttcctttgtagggtaatttgcttggcttgcgtgntttac

SEQ ID NO: 351300 - DNA, 1146 bp, Homo sapiens
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagggcctgtcctttgtaacctgaatacaagcaaggactaagtgaagagccatttcatcagtgatagaagctatttgctttgaaaacatcaacctatttataggtctctattttttaaattgaggtgaaattcacataacatacaattaaccattttaaagtatacaatttagtgatatctagtacattcacagcattgtacaaccaccactctctagtttcaaaactttttctcc

SEQ ID NO: 351301 - DNA, 1187 bp, Homo sapiens
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgggtatatctggagttatgttgaattcatgaagattatgtttctaaaatattgatttttatctcctcctgtaatatccacggtgagagaataaagtttctagcacctttcaaagtacatgtaaaaatctgcaaacgtgactacaaaaaactaaaaatgttttgcatagcaaaaaaatcccaacagagtgaagagataatctacagaatgaaagaaaatatttgcgaagtatacttatgacaaaagataaacttacagaatatataacaaacttaaaacaaaaataacaatttaaaaaccacaataaaatatcacatcacagccaggcacggtggctcatgcctgtaatcccagcactttggtttgtggggaaaagcaagagagatcagattgttactgtgtctgtgtaga

SEQ ID NO: 351302 - DNA, 896 bp, Homo sapiens
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagttagaaaactcacctgtagcctggatagtctcatgtcttggggttcttttctctggcttcttctgaaggcagcagctcagctcattacgcgtgcagcctcatcagcaagggtggccttacacaccatctgagagcaacgcatagtagttggttggggtcctagttcctcttggaagttgattgacttcatccctttatttaaataaacattcaatct

SEQ ID NO: 351303 - DNA, 481 bp, Homo sapiens
  misc_feature (427)..(427): n is a, c, g, or t
  misc_feature (440)..(440): n is a, c, g, or t
  misc_feature (476)..(476): n is a, c, g, or t
aatgagtgtgaggcgtattataccatagccgcctagtattaagagtactgcggacatgtactatagacccagcgactggtggcttcgacatgaggctttaggagagtgcacaggagtccacctaaaaaaaaaatccttgatactgttgcctgcctttttagtcaccccgtaacaagggcacacatccagcactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcaaaaaaaaaaaaaaanttctcggcgaagnttttcctttgtagggtaatttgcttggcttgcgtgntttac

SEQ ID NO: 351304 - DNA, 802 bp, Homo sapiens
atcttgtcagcaatcgtgattatattatacatgcatgttgtatttccagttttatggctgctctggtgctgctgtggagcattagacatttattagcttcccctgggcttccctacagcttaccagagctatgagagtctgaaaaatcagttgtccgaaaaatgagttatctattggaaattatgtgctggatatgcccatatcacacaattccccagatccagttacatttgagagcacttttcactatttctcactctttctcttagaatcagcctttccctcccattgcagggtcatgaaatggctgtgaatttgtccaaagcaggtattgagacaactgtcatgactgatgctgccatttttgccgttatgtcaagagtcaacaaggtgggtatatctggagttatgttgaattcatgaagattatgtttctaaaatattgatttttatctcctcctgtaatatccacggtgagagaataaagtttctagcacctttcaaagtacatgtaaaaatctgcaaacgtgactacaaaaaactaaaaatgttttgcatagcaaaaaaatcccaacagagtgaagagataatctacagaatgaaagaaaatatttgcgaagtatacttatgacaaaagataaacttacagaatatataacaaacttaaaacaaaaataacaatttaaaaaccacaataaaatatcacatcacagccaggcacggtggctcatgcctgtaatcccagcactttggtttgtggggaaaagcaagagagatcagattgttactgtgtctgtgtaga

SEQ ID NO: 351305 - DNA, 401 bp, Homo sapiens
caggttgaaagtaggatcatagaatcagttttgttattgttgcagggcctgtcctttgtaacctgaatacaagcaaggactaagtgaagagccatttcatcagtgatagaagctatttgctttgaaaacatcaacctatttataggtctctattttttaaattgaggtgaaattcacataacatacaattaaccattttaaagtatacaatttagtgatatctagtacattcacagcattgtacaaccaccactctctagtttcaaaactttttctccactgtagaaaaacaccctgtacccattaagtaatctctccctatttgtccttctccccatctcctccaatctgctcctgtctctatggatttgcccattttgtataaaaggaatcatataata

SEQ ID NO: 351306 - DNA, 357 bp, Homo sapiens
ttatatgaacataccacaatttattaatccattcatctgtttatgggcatttgggttggttccagcttttggcttttgtgaataatgctgctataagcatctgtgtataagttttctgtgtggacatatgttttcatctctagggtacatacctaggagtggaattgctgggtctctagtttttataaattttttcctttttagttttccccaatgaagaagactcatttcataagtttgtggctcctgaagaagtcctgccattcacagaaggtacagaagctgtgtgtgcatgcgtgcatgtgttgtgtgtattcggggtttgtgtgtgcatgtgttttggtctttttgttgttt

SEQ ID NO: 351307 - DNA, 592 bp, Homo sapiens
gaattcatgaagattatgtttctaaaatattgatttttatctcctcctgtaatatccacggtgagagaataaagtttctagcacctttcaaagtacatacttaggcctttttaatctgttaactgaatttcttttcccttttttctgcatcattgttcctctcttggagtagcctctaaatttggttgaagcattgaaaagaatgaagtattaaatagaactaaggcaagagtgtcagtttctagggattggctacagggctcctgccttatgctcaaagagcttggcagttgtggatagtgaatgaaaaagattcctggcttctcagaaggtatggcatctcaatttccagaaaatatgggactgagagcagtaggttttgcagtttcttgtcccattttacattcattctttccttggaaacctacttttaagctagaacttgtattgagccagggatcccttcacctctaccagtctgtgacccctcacgataccaattctgaggtctaagcatttagctttttgtggccagtggcccttttagggctccacccccaggatggctcacattttttgtcttgtcccaaag

SEQ ID NO: 351308 - DNA, 977 bp, Homo sapiens
  misc_feature (880)..(880): n is a, c, g, or t
  misc_feature (882)..(882): n is a, c, g, or t
  misc_feature (896)..(896): n is a, c, g, or t
  misc_feature (900)..(900): n is a, c, g, or t
  misc_feature (907)..(907): n is a, c, g, or t
  misc_feature (911)..(911): n is a, c, g, or t
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccacccaacatgtngnccctttcacttccncagnccatganaacntcaagtgggctgaaatcgcctcaaggcttcgaagggtccttgagaaccgaaatcctttcccggggc

SEQ ID NO: 351309 - DNA, 1586 bp, Homo sapiens
  misc_feature (1532)..(1532): n is a, c, g, or t
  misc_feature (1545)..(1545): n is a, c, g, or t
  misc_feature (1581)..(1581): n is a, c, g, or t
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccagcactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcaaaaaaaaaaaaaaanttctcggcgaagnttttcctttgtagggtaatttgcttggcttgcgtgntttac

SEQ ID NO: 351310 - DNA, 1620 bp, Homo sapiens
  misc_feature (1566)..(1566): n is a, c, g, or t
  misc_feature (1579)..(1579): n is a, c, g, or t
  misc_feature (1615)..(1615): n is a, c, g, or t
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaaatgagtcttcttcattggggaactgtggagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccagcactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttcaaaaaaaaaaaaaaanttctcggcgaagnttttcctttgtagggtaatttgcttggcttgcgtgntttac

SEQ ID NO: 351311 - DNA, 801 bp, Homo sapiens
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagtaaggagactgctggagttgctactaagaaaaatgaaaaatgaagaagaaataaacgagagatgggtagggccattccaaccttgaattgataagcaagactttgagacactgagaagatca

SEQ ID NO: 351312 - DNA, 739 bp, Homo sapiens
ctcgcccgacccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggtgaggccggcctgcctccgccggcgaacctggcccctgtctgttcccgatcccagggctgaaaatttcccaggcctcacttcgcgttggctcctcttatcctctctcttttggactgtaggggagctgatggagctgatccgcagagagggcaggaggatgacggccgctcagccctccgagaccaccgtgggcaacatggtgcggagagtgctcaagattatccgggaggagtatggcaggtcaggctcacgtcctgggctcctggttggatccagtgacactttttgcacgggcccctctacctgctcggagactttattggagctgaacagcccttgttacctgcctgaccactcctccccacctctctctttgggtcttgttgcctctatagactccatggacgcagcgacgagagtgatcagcaggagtccctgcacaaactgttgacatccggaggcctaaacgaggatttcagcttccattatgcc

SEQ ID NO: 351313 - DNA, 443 bp, Homo sapiens
caggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgaagccttgggttgggcatggtggctcccatggtaatcccagcactttgggaggctgaagctggaggatcacttgagactaggagttcaagactagcctgggcaacatagcaatatcctgtctccatgacaaaaaaaaaaa

SEQ ID NO: 351314 - DNA, 351 bp, Homo sapiens
caggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgtagcctgggcaacatagcaatatcctgtctccatgacaaaaaaaaaaa

SEQ ID NO: 351315 - DNA, 532 bp, Homo sapiens
cctctctcatctaaataagatttttaacatttagcaaatatttaatatcttttcctttatatttgttagttcagaataggctatttaagcagttctttgaaactagaagcccccaactgtttagaaaaaataaaccttggactagttcaagaagataattttaattagagatatcaatctcttgaattctgccttcttaataattcttgtatctgtttgctactccatctcaaaaacaaacaaacacccagaattatgtttaactaaatatctgggtaccccatggcctagtaaggctgatacataaaattaaccatcataaatgtaatattgaaagtgacctatatcacctctacaatatactgtttgttaaaagtgagtcgctaagttaagcccactctctcaaagggagaggaattaagctctacctctggaaggaaagcatatagaataacacgtggacatatttttcaaaccactctaaccgctggtactaggagactccagtgttatactccagtgttcattgaat

SEQ ID NO: 351316 - DNA, 1829 bp, Homo sapiens
aagcttgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaaattaaagcaattctctactcatatttttatattcattctatctctttctccatccttctcaactttcaccaagttcacaagtatatagagctcttatcctcagtgtctaagccaatgcctgatactattacgtacgatgtgcattaactatgattccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagtcagataaaagtaaaaaaacaaaagtataaatcatgtcatccctcccccatttgcaccgacatctctaaccacagacacacacacgcacaccatacgcaaagatagtcaccataattgaccatgtttttcaccttttagtcaatgttagaagcaaggggtaacttaagtcctggtgggaagaccatccattgagttctttgaaagtcaacatttttcagcccacgatagtgaaatgaaagtaaatataaatgaataacaattctaacaaaaagagttttttgattcaaatccattagtttgaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaa

SEQ ID NO: 351317 - DNA, 1171 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtaggagaatcgccccccttttttgaatgtttaaagagtttgctgcagtatgctgcattccatgtgtgctgcttacgggagccagggaaactggattccactaattcaattgtaatacttgcgggggaccctggagttttacgtaacattttgatttgagaaaaagaaatggcaaagcttgaatctatgccgcctgtttggggtgaggcaagaaatcgagtttttatgcaaagaatcgattcatttattatattattttttaaaaaccatttgaattctttggagcaatcttattttcttgctgtgaaaaattgttatattgccatagctagttcccaaatagataaagtttacatggatcctattatttgaaaacagacttgcaattaaggattaaaaaaaaattcatggtaaataatcatcggttgaatgtttggccaaacgtatgtgtctatttattaaaaattagggacctacctagctctacaatgctacagctttaattgagtttcaaaagcacattttaaacaacctagcaagaggtagctttctggcaagttttcgatactgtagttcaatgtttacatttcttttcctggcatgtctgagcctttgtttccagcttaaaagtggaaccattatattcaaaagtaaagctgggttaataatgcttactgcaattatctgatctttatgcatttttaatgagaacacacagccagcagaataatttaatgagggcaggctagcttttaaagctgtgttttcactatgccgaaccatatcaactttctcgctgagaagcagcagtgagaaatgatggagaagatttatttttaacacacttggcccaggagaaggaaaggatatatttgctaaagaattctttctgcccttttccgtttaaatttctgccaggcatgaggaa

SEQ ID NO: 351318 - DNA, 4968 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaaggaaaaaaaaaaacaagggtgggggcccggccgagaaaattaaacattgggggcgggcccagggtaggaaatgtcagaggtccaagaacggccgaagggggtcccaaaaaagccgggcgcggggtgcaccaggtggctttgtgctcaggcagcagacccgcggcgcggagggaacgcaggagaagagccagaacagaaggccaacaacacaagaagatt

SEQ ID NO: 351319 - DNA, 4699 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351320 - DNA, 4753 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351321 - DNA, 4606 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351322 - DNA, 2980 bp, Homo sapiens
aagcttgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351323 - DNA, 3507 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaaattaaagcaattctctactcatatttttatattcattctatctctttctccatccttctcaactttcaccaagttcacaagtatatagagctcttatcctcagtgtctaagccaatgcctgatactattacgtacgatgtgcattaactatgattccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagtcagataaaagtaaaaaaacaaaagtataaatcatgtcatccctcccccatttgcaccgacatctctaaccacagacacacacacgcacaccatacgcaaagatagtcaccataattgaccatgtttttcaccttttagtcaatgttagaagcaaggggtaacttaagtcctggtgggaagaccatccattgagttctttgaaagtcaacatttttcagcccacgatagtgaaatgaaagtaaatataaatgaataacaattctaacaaaaagagttttttgattcaaatccattagtttgaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaa

SEQ ID NO: 351324 - DNA, 2277 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatggggaccgaactgtgcatggggaccgaactgtgcatggggaccgaactgtgcatggggaccgaactgtgcatggggaccgaactgtgcatggggaccgaactgtgcatggggaccg

SEQ ID NO: 351325 - DNA, 464 bp, Homo sapiens
  misc_feature (8)..(8): n is a, c, g, or t
taggcccntgggagcagtatctcagtctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351326 - DNA, 4752 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351327 - DNA, 4658 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351328 - DNA, 4640 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351329 - DNA, 3031 bp, Homo sapiens
gtgctcgctgcctgttattaaaagactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatattttgtagattaattgttgtaacattgtctttcttttttttctttgtgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 351330 - DNA, 3604 bp, Homo sapiens
ggatttgtcggaaggaagggctgcagcttacagcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagcaattacacataatattcatttaaaacagctgttataaatgaatattatgtgtaattgtttcaaacagctgttttgttttttaaacataa

SEQ ID NO: 351331 - DNA, 242 bp, Homo sapiens
taaactcaaacacacacaaagatacatgctaattaaactgtctaaaacaaagacaaggagaatcttgaaagcagcaagagaagtcactagtcatgaactaaagacccgcattgataatcagaggatttctttttttttttttttgagatggagttatgctctttctcccaggctagagtgcagtggtgcgatcttggctcactgcaaccttcgccttccggtttcaagtgattctcctgcct

SEQ ID NO: 351332 - DNA, 191 bp, Homo sapiens
gaccaactccatcagaactggccttctccctgtccaccaccctcactgatgtcccgaagtgtagcttcatttgggaagctttgtctgcaacagccatctgtctgtatattcactttccccaccctgttgcccagtactcttaggggtcttcttggccttttgagcctgttcttccaattggactgcaagct

SEQ ID NO: 351333 - DNA, 509 bp, Homo sapiens
gggtgaaagtggatcctcataaaggttttcatcactgtcatcttcactttgagtaggctgaggaagaagaggacagtcttgcttggtcttgctgtctcagaggtggcagaggtagtggaagtataatagaaggggaggcaggagagatttattgaaaaacaaagaaaattgcatccaagaactgtagtacaatatcaaatggtctgccattgaacaatgcagaggttaggggcaccaactccccacgcaattgaaaatctgcatataatttaactgctgattaactactgttgactggaaacctgacaaataacataacagtcagtacgtattttgtgtgttatatgtcttatatactgtattcttccaataaaataagctagagaaatgaaattaagaaagccaggaaaataaatattacataaaaatgaacaaagataagaatgaccataggaatcttgacaaaaactgtaagcccacagataaaagtgacacctttaaggtgctga

SEQ ID NO: 351334 - DNA, 184 bp, Homo sapiens
gtgagcttattggtgtctccagaaaagattcctccagtctttcagcagataggtggaaactataaagaatcaaatggagatgataaaaatttaaaacatgataaatctttgggcatatcaacagactagacatgcaaaagaatgcattagtgaacttaactgttggtgaatagaaattatccaa

SEQ ID NO: 351335 - DNA, 3021 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351336 - DNA, 3032 bp, Homo sapiens
aaaaaaaagtaccaaagccgaggcgcatcctcgcacctgcctgccttgggccagcgggcggggcccgggaacgtgcatttcaaaggggccgcggttcctgcgatgcgctggactctgggaagcgcgaacagagcgttttgcgggctctgcggggagagctggcgccggcgtctccctgtagcaggactgggcgccgcgcccgtgggtgggctgctgcccggccccgccgcccagccaagccgccgcctgggtggccattcccaagccggactccggggaagtggcagcgtggatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351337 - DNA, 2422 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaagtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351338 - DNA, 2546 bp, Homo sapiens
ctgcaagcttggtcggatgagtaataaaggctctctcttgaatcatatggataatgctggcaagtgacagaaatagaagagagttcttttaaaaatacaaggcacttggcttagaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaagagttttttcttcatctttattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351339 - DNA, 3181 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaaacaagattatgaaaaaaaaaaattgtgggggggcgggccaaaagagtttaaacaattgtgggggggcacctgttgagaggggagggccaagaaccgggtcgagggggctccaaaaaccgggggggtgtgcaacagggggggttggtcacaggacggtagg

SEQ ID NO: 351340 - DNA, 1055 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaaggtaacaattttcctaacaaaaaattcagttaccgaatggactccttttggaaggactgattctccttgttggtgtggtttggctgtcttacttggggtcatgggctgccttggaacaggctagagaatagtataattagctcccatcaacagcagggtctcagaagctcaaggacagcaggaagtgaagagaccttaaaaatgatgtgagggctggtttaaa

SEQ ID NO: 351341 - DNA, 3204 bp, Homo sapiens
aaaaaaaagtaccaaagccgaggcgcatcctcgcacctgcctgccttgggccagcgggcggggcccgggaacgtgcatttcaaaggggccgcggttcctgcgatgcgctggactctgggaagcgcgaacagagcgttttgcgggctctgcggggagagctggcgccggcgtctccctgtagcaggactgggcgccgcgcccgtgggtgggctgctgcccggccccgccgcccagccaagccgccgcctgggtggccattcccaagccggactccggggaagtggcagcgtggatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351342 - DNA, 3040 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaagagttttttcttcatctttattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351343 - DNA, 2663 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351344 - DNA, 1972 bp, Homo sapiens
gttaatggcaggaggctgtgtttgatttctgctttatgggacagccaggaagagataacggttttggctagctgagctgattgcccctcatccttaccatgcacagctttattccttctttactatagcattgcagttatatctcccctttaacacactggctggataattataaaatgattttactgtttctaaaactacagccatacccatcaagcatgacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggtttttagttaatttatggcgtactttgtttatccattggccaacctgaaggaaatgaaactcacctatctttctatcacagatgaatgtgctagatgaatgattgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaa

SEQ ID NO: 351345 - DNA, 1788 bp, Homo sapiens
ggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaatcttttattaaagagccgtcatatgccgtgtttcctccataggaagtctttctcactgtctaagccaagcttgtccagcccacaggtcacatgctggctttgaatccagcccaacacaaattcgtaaactgtcttaaaacattatgagatatttttgcaatttttttttttttagctcatcagctatcattaatgttagtgtattttatgtgtggcccaagacaattcttccaatgtggcccagggaaagccaaagattggacactcctgataagcgctcagtcaatagtttcttctttaaggttcgttagtacacttattggtaccattcatttgatataaaactctgctatctttgttgctctttgtttacttctttgtattcataatgtttcaattttatttttaatttttatgtcttttcaaattctgaaatagcctccctcaaagttagtcaccactctaggtaatcattctgttgcttttctttgtaactttatatatttgaatctataattattgtttaattttgaatgagtttgaactttatgtaaatggaattatattgaatgtatattttccgtaacttactttttaa

SEQ ID NO: 351346 - DNA, 762 bp, Homo sapiens
gagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 351347 - DNA, 702 bp, Homo sapiens
ctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 351348 - DNA, 975 bp, Homo sapiens
  misc_feature (769)..(769): n is a, c, g, or t
gagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaanaaaacaaaaaaaacaacacgagaagaacaacagcaagagaaaagaaacaagaaagacaaatgggagacatgaatagacgaagagaaaaaaaagaagttatagagagatagaacaagaagtaagacgccgagtattttagaagacgtgaaaaaaagaggagcaacatagggaggaggaataatagacaaagagagagcgaataaagc

SEQ ID NO: 351349 - DNA, 915 bp, Homo sapiens
  misc_feature (709)..(709): n is a, c, g, or t
ctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaanaaaacaaaaaaaacaacacgagaagaacaacagcaagagaaaagaaacaagaaagacaaatgggagacatgaatagacgaagagaaaaaaaagaagttatagagagatagaacaagaagtaagacgccgagtattttagaagacgtgaaaaaaagaggagcaacatagggaggaggaataatagacaaagagagagcgaataaagc

SEQ ID NO: 351350 - DNA, 1101 bp, Homo sapiens
gagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacaaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 351351 - DNA, 1041 bp, Homo sapiens
ctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacaaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 351352 - DNA, 373 bp, Homo sapiens
gccagggttaccagcgctttctcctctacagtgagtagggatacaaggcaggaagggttggagggaaacaagggagggcaggagaactcctcactctgggtcctatgacaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtg

SEQ ID NO: 351353 - DNA, 815 bp, Homo sapiens
gagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaataaaaaaatcgaactgcagataacgcttggagcagcccgtggccccaaaac

SEQ ID NO: 351354 - DNA, 654 bp, Homo sapiens
cgcagttaggggacaagaagccccggctcctcttgcctaaaaatgtcccacaaattggggcagctttgttcacttctattttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 351355 - DNA, 759 bp, Homo sapiens
gagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgtcttattgactcctaggaatcaaggcctgtgagctgtccaataactgacctgtaacttcatctaagtccccagatgggtacaatgggagctgagttgttggagggagaagctggagacttccagctccagctcccactcaagataataaagataatttttcaatcctcaaataaaaaaatcgaactgcagataacgcttggagcagcccgtggccccaaaac

SEQ ID NO: 351356 - DNA, 5157 bp, Homo sapiens
acgggaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaaacatttcttctgtggttgaagtaggggacaggtacaggtagaatatttgaagctctgctgccttcatttttgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351357 - DNA, 5275 bp, Homo sapiens
acgggaacggaagtgtggcggcgttgggttgagcgggctttttggaagtttgtggcggaggtgaggccgaggtgactgcagagcggctcgcgagggttttggactgataaagcaatggaagccactgaagagctttaagatgaggatggcatggagggaagataagtcacataatcagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaaacatttcttctgtggttgaagtaggggacaggtacaggtagaatatttgaagctctgctgccttcatttttgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351358 - DNA, 6068 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351359 - DNA, 5941 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351360 - DNA, 4643 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351361 - DNA, 4726 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351362 - DNA, 1876 bp, Homo sapiens
caagagtttcttttccattcctagatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351363 - DNA, 4091 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgtcagagcatgggggacagaatacttctcggataccagggttacacaa

SEQ ID NO: 351364 - DNA, 1942 bp, Homo sapiens
acaggagagaattggtctccatgtggagggaaaaccatatgggaaaccacagtgcgcaaaaaggacccagttggtgcaattggaagtaggaattagtttggtgttgctggggtgtggtttccatgtaaaaataaccagcccgaaggtaaaagggtgcccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351365 - DNA, 1260 bp, Homo sapiens
gccaaaataggcttaagaatttcaagtcagaaaagcaactaaatttctacaagtgatcctgccctcctcagccattttctagataacaacaaatactggaattataaatgaaatggatcagtgcaattatctctactggcatttgggtccttccagattgaactgccaaaaattttagattactggtatacaagtacaactgcatttgattgggagacagactagttttcccctaaagccatacagttttgtaagtgacagcttcagaggaaaacttcaaaaaccattgaacctgaaatttaagtcttatgttctttgcccttaggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351366 - DNA, 1114 bp, Homo sapiens
acgggaacggaagtgtggcggcgttgggttgagcgggctttttggaagtttgtggcggaggtgaggccgaggtgactgcagagcggctcgcgaggagtctccctctgttgccaggctggagtgcagtggcgcgatctcggctcactgcaacctccgcctcctgagttcaagtgattctcctgcctcagcctcacaagtagctgggactacagggttttggactgataaagcaatggaagccactgaagagctttaagatgaggatggcatggagggaagataagtcacataatcagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagtgagtaatatagtgtagaaataaagatcatttttacaaattca

SEQ ID NO: 351367 - DNA, 1101 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatga

SEQ ID NO: 351368 - DNA, 962 bp, Homo sapiens
  misc_feature (958)..(958): n is a, c, g, or t
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagtgagtaatatagtgtagaaataaagatcatttttacaaattcaaaaaaaaaaaaaaaaaaaaaaaaaaaaaaaaaaaaaaaaaaaaaanaaaa

SEQ ID NO: 351369 - DNA, 332 bp, Homo sapiens
ccagttggtggaatcgggggatttgcagaaagaaatagcgtctgagatcataggattactgatgctggaggtaagatggcaaacaaaaacttttatttgggggtaggtttttgagggtttgtaatttgttgagggaaggaaaacttaagtgcccaacctagcatagtccttatttatgagtaagacctgttgttaaaaaacaaagaagcaggccgggcatggtgactcacacctgtaatcccagcactttgggaggctgaggtgaggatcgcttgagctcaggagtttgagaccaccctctgcaacatggtgaaaccccatctctaccaaaa

SEQ ID NO: 351370 - DNA, 324 bp, Homo sapiens
aagcccttaaccattgctgttctaagcaccgtagtaatcagtcgtttgataattctgtttttttgtatttaactacaaacctgttcgtttttcctatttacctgtcaatgttgtaagacttgtttctgaaccccctgtttaaaacaataaggttccccctgctctgaggaagctggaacacttaggagacgtaagatatacacttgttgtatccagttggtggaatcgggggatttgcagaaagaaatagcgtctgagatcataggattactgatgctggaggtaagatggcaaacaaaaacttttatttgggggtaggttttt

SEQ ID NO: 351371 - DNA, 545 bp, Homo sapiens
ttatatagcagagcaaacatagccgaacatagatgctttcatttcacgtgagcaaacatagccgaacatagatgctttcatttcacatatagtggtttggtctggtaaaaggatcatacttctcatccaaggaaaacatgcattatctcttgtattgccacattttctttgcggaggtaaaagggataaagatctcagaaagggtagactataggccccataaattcttacagtaagaggtatttcaaatcttgtttcaacatgaaagtgttctatacattcttagtttgagtctaagtcatagattatttatttaaatttgtactggagaattctttaagctgaaaactactttgaattcaaattggttattttgctgttaattgggagaccttaccaattttgtattgttttcagggaagcagaaagagtgttttggaaggaatcatagccttcttcagtgcactagataagcagcacaatgaggaacagagtggtgacgagtgagtaatatagtgtagaaataaagatcatttttacaaatt

SEQ ID NO: 351372 - DNA, 257 bp, Homo sapiens
aaaaatatggtcatttatattagggcatttaggactgtcaaatatggtctcaataggaaaaaactgagaagaggataaagaaagtgttatttttaagttatgattgtccagatcactagtatctctgttaaagtgcttatttcttctctttgattcctcttaggggttttatgatgttcttcgaaggaactctcagctggctaattcagtcatgcaaactctgctctcacaggtaaaatacatttttatggatatat

SEQ ID NO: 351373 - DNA, 418 bp, Homo sapiens
gtccagcaatgagtttatgcgctatgcagtgaatgtagctctgcagaaagtacagcagctaaaggaaacagggcatgtgagtggccctgatggccaaaacccagaaaagatctttcagaacctctgtgacataactcggtaagccactcccaccccttagaaacttattccacttggctgtggtgtctccaagagaacaaactgggaacagaggatgaaggtaatttgaggttggacatattttaggagtgaaagaatataaaacattagccaggtggcaggcacttgtaatcccagctactcaggaagctgaggcaagagaatcacttgaaccaggaggtggaggtcgcagtgagctgagttcataccactgcactctagcctgggtgacagggcaagactctcaaaagaaaaaaaa

SEQ ID NO: 351374 - DNA, 5191 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaaacatttcttctgtggttgaagtaggggacaggtacaggtagaatatttgaagctctgctgccttcatttttgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351375 - DNA, 5411 bp, Homo sapiens
acgggaacggaagtgtggcggcgttgggttgagcgggctttttggaagtttgtggcggaggtgaggccgaggtgactgcagagcggctcgcgaggagtctccctctgttgccaggctggagtgcagtggcgcgatctcggctcactgcaacctccgcctcctgagttcaagtgattctcctgcctcagcctcacaagtagctgggactacagttccagatggaaacatgtggaagggcctgtggcagaaagaacttggagatttgaaggactggaagcaattctgcatggctggagcagagtgatgaaagggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaaacatttcttctgtggttgaagtaggggacaggtacaggtagaatatttgaagctctgctgccttcatttttgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351376 - DNA, 5393 bp, Homo sapiens
acgggaacggaagtgtggcggcgttgggttgagcgggctttttggaagtttgtggcggaggtgaggccgaggtgactgcagagcggctcgcgaggagtctccctctgttgccaggctggagtgcagtggcgcgatctcggctcactgcaacctccgcctcctgagttcaagtgattctcctgcctcagcctcacaagtagctgggactacagggttttggactgataaagcaatggaagccactgaagagctttaagatgaggatggcatggagggaagataagtcacataatcagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaaacatttcttctgtggttgaagtaggggacaggtacaggtagaatatttgaagctctgctgccttcatttttgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtcattcagacccagcttgtaggcaaacatgcacctgaaagagacccaatctactctcacagtcatgcccctcctgtgaacagatgcatcactcctggagcaatgaccccaacaccccttagagcagggcttcccctggaccaacaccccatctgttcacttagctaagtcaagaaaggtgaaggtccagcactgtttccatccagcagcctaacctcccactgaga

SEQ ID NO: 351377 - DNA, 3944 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaa

SEQ ID NO: 351378 - DNA, 3994 bp, Homo sapiens
  misc_feature (3990)..(3990): n is a, c, g, or t
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaaaaaaaaaaaaaaaaaaaaaaaaaaaaaaaaaaaaaaaaaaaaaaanaaaa

SEQ ID NO: 351379 - DNA, 2439 bp, Homo sapiens
cacggggtccttagtctagttacaaggcctgataccaaagccaggacaaggatacaagcaaaaaagaaaactagaggccaatatccctgatgaatatagagtctgctgtgttaaaggcagactcagaaggctatatactgaatgataaccatttttgtatgatgtttcgtagaaagtaaaaccatagggacagaaattagatcagtagttgcttggaaatgggaggagagaattgactatcagtgagcacaagggaacttttagagtgatagaaataccttgattgtggggagattacacaaccatgtaagtttttttaaacttctagaactgttcacctacagggtaagaattttactgtttgttattttatctcggtgaacctgtctttaaaaacaataccactttctcctgcttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351380 - DNA, 4101 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcactgcgtgacagatatttactctataaccgggatcctcaagatcagcc

SEQ ID NO: 351381 - DNA, 1233 bp, Homo sapiens
atattctgccccactgtctgtttacttgttctgagtcaggccgagaaggttctagaagaagtggactggctaatcaccaagcttaagggacaagtgagccaagaaaccttatcagtatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcacccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattctctttaa

SEQ ID NO: 351382 - DNA, 3620 bp, Homo sapiens
acgggaacggaagtgtggcggcgttgggttgagcgggctttttggaagtttgtggcggaggtgaggccgaggtgactgcagagcggctcgcgagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacaggtaaaatacatttttatggatatatggaaaacagaccatcaaggatcgagagacagttgatggttttcagacctttcaaaatataaaataattcccaactagtacattagtactttgtgaacatgctgtgggtatgttatgctgttctgggttgtcttatctcggtcaccacttacctgtctgccataataccatcatctagcagttatccttgtgaattaacagtctgtatcctaagtcagaaggacattttgaagaaccatttatataaggaccattgcaactgtatccattatgttatatttctgaaagaaaaa

SEQ ID NO: 351383 - DNA, 487 bp, Homo sapiens
gtttcataggacagtctactaaatctaggaatctttttttattagtatctccaggtgtgtcagagctccggaggaattccaaaaaatatggaaaagctggtgagttgagaatgcctttcctaggaatgggggaagcacttttactgctggttacattggtttccttctcccttgttgtgcaggtgaagctgtctggttctcatctgacccccctgtgttattctttcatttcttacgtacaggtaagagattcagaggcagtacccaataggtcttcaagaaaggatttcttacatgcccaggggactattgatcacctgaactgagcatatataaacttttttccctgcttaccacaagctggaggcacccatcagagaccaagccaaggcttgagggctttgcagcaaggacatctttatgtaaagaaaactgtttcacttaatttggagaaaggaagcatatatgtttgcatttggagcaagga

SEQ ID NO: 351384 - DNA, 552 bp, Homo sapiens
attatctaacacatacattgacatttgttgtctgttttccttcaactttaatataagctatgccacgagaacaataatctttggctttctcctacagttatattccccagtcaacagtacctgggatataataggtgctcaataaatatttgttgttgaaagaatgaatgatctgagtctgtattgtggcaagtttgattgtattgttttggcagagcccaatgttttagagatcaaaggtgcagtaaagttgacagttttttgtgaaaattaggagttcttacctaagttgtcagttggatatagtataggccaggaatatgtatctgaaggcaaagccaggatttaagggaaaaaaaagttctttggcttctttacaacatgaattgagcacctgaagttgtgttctaaactgttttctaaacttgtctgaccataggaattgtctgagacattccttaaaaacggcagaatctgaagcttctccccacacctcctgaatcaaaatttctagaggaggaaccaggatattcttattaaaaacaaagaggg

SEQ ID NO: 351385 - DNA, 2628 bp, Homo sapiens
  misc_feature (1)..(1): n is a, c, g, or t
  misc_feature (5)..(6): n is a, c, g, or t
  misc_feature (10)..(12): n is a, c, g, or t
  misc_feature (15)..(15): n is a, c, g, or t
  misc_feature (17)..(18): n is a, c, g, or t
  misc_feature (21)..(22): n is a, c, g, or t
nactnncttnnngtntnnttnngagattgcatactcaagaagaggaggaacataaaatacgtgatgtcttctcttaagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351386 - DNA, 1249 bp, Homo sapiens
  misc_feature (1217)..(1217): n is a, c, g, or t
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagagatgggatctcacaatgttcctcaggctggtgtggaactcctgggctcagcgattcttctgcctcagccacccaaagtgctggaattacaggagcgaggaaacattttctaccaggaatctttatgaaatgtgtttgtaaataacaaaaaacattttcaaattgttggaaatttctcagcagttagtgcattaaaaaaaaaaaagtttcaaccagcatgtgtttcctcatcttaaacaataagtagcaatgtttggaaaatgtttgttatantatctctctaaataaaagttgatagttcccgt

SEQ ID NO: 351387 - DNA, 2833 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351388 - DNA, 2014 bp, Homo sapiens
ttacttctaatatttaccgaaaataaaatcccaataccgaagctaaactgcaacagactctctttattttccaccgctcatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351389 - DNA, 2147 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaatagctgacaagattaaaacaacgccatatacccgcgtcgtcgttgaactgagatacatc

SEQ ID NO: 351390 - DNA, 1683 bp, Homo sapiens
tcattccctggtatttcgagaatatgggagagaaccagtgtgccacacttaccaggtctttatcacctctgtgctgagtccagcaaggagaagcgttgatgcctttattcaacaaattcctatgaggactggagtagataaataagtttgaccccgaacatgatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351391 - DNA, 1555 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagcagccacttaatggggggccgactcgatgag

SEQ ID NO: 351392 - DNA, 1628 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttttgaccctgaagatcctggaagagaagctgggaggaaaagagacccagcattgcattaccatcgtggaataatctagcgcaaaccacaaagtccaaagccacctttgtactcacctgcagagctccagaagaccttgatggcagcctgcctatgctgtgtgtttgctatattgacttctgtgacagtaagccaagtgcaaaaatacacttgatgagaatttcctcttttaataatgttatttgaacaccacatattttagatttatttccattgtgcctggaaaccacactcctttagattgggggccgagaggcgacaacccaacattgaggagagtttatttttaaacaggggttagcggccttattgagtgcggtgtgttaagggtttgtatgttatactggtaggttcttgcgtcgagatcacttggaataagaaaccactggcaggtgaggcccttgggatgggttacaaaaagacgccggagagaggttcaatagacgaaaggacccgcaatgccggggcccaccacgggtgtgcgcgcagacttttctttcggggaggagcaaccg

SEQ ID NO: 351393 - DNA, 650 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccaagaccggagaaatactacttccaaatgcaaaggtgaattccactggtcttcctacaagaaaataaaaaagaaaa

SEQ ID NO: 351394 - DNA, 2281 bp, Homo sapiens
tagggcgggtggtgaatcggcacgaggctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351395 - DNA, 2879 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatctttcgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgt

SEQ ID NO: 351396 - DNA, 2163 bp, Homo sapiens
  misc_feature (2107)..(2107): n is a, c, g, or t
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataccagccagaaaagggangattcgccctgaacctttcctttttttccatatcactcgcgagtataagaacaacc

SEQ ID NO: 351397 - DNA, 2147 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaatattgtaggcgacaaagccttttttggccttaaacatttaactttcgtcctctcgtgag

SEQ ID NO: 351398 - DNA, 604 bp, Homo sapiens
tgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccaagaccggagaaatactacttccaaatgcaaaggtgaattccactggtcttcctacaagaaaataaaaaagaaaa

SEQ ID NO: 351399 - DNA, 502 bp, Homo sapiens
tagggcgggtggtgaatcggcacgaggctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagagggacaggccatgttgttacctttcagatggattgacctcagtagccttttgttggaaatgtgcaggtcaaatgttcctgtctgtgctaagagacaggtttcaccgtgcttgccaggatggtctcgatctcctgaccttgtgatccgcctgcctcggcctcccaaagtgctgggattataggtgtgaaccactgcacctggcctccaatgttctattattgtaaataaaactgtgataaacatcttg

SEQ ID NO: 351400 - DNA, 525 bp, Homo sapiens
ttttttttttgtcttcctctaccctcaaagcaaggccatttaacctcaagaaaaggaacactggatttaagtaaaatgtaggttgatttaatatattaacccttcctaaatttagtgtaaatctaaatacaaaataactttttattattattcaaggtttgaagatgtgtaggtgctgcaaattacgttagggctatgaaaacacccttataaaatttttatagaaatattgtggtgcctaaatagagaatcgtgaaatttttaaaaatcatgtataagaattaaattgagacaatgacccagagattctatttacttgaaaacttaagatagtgaagaaaacagatgggttgagatgtttcctatctgatccattaatttatttgggtgcgtcagtatgacctatgtataggatgatgtactctctgcttccacaaaaacacatgagctttcggtttccatggaaaccgttgtgagtagggctgtccaattccgggattagtcggccctcgtactacggcaggg

SEQ ID NO: 351401 - DNA, 102 bp, Homo sapiens
ctatgggaggattgttgttattattgcttgatttacatgctctcattttatacaaagtgtacagcacaatttctcaaagagtaattatgatgccaagaaaat

SEQ ID NO: 351402 - DNA, 568 bp, Homo sapiens
tctccggatgccaaaggatttgacagtgtatctagctttggaaacacagggggtctgccctgtgagctgctccaacaccttggctgctcgcgtcagtctgtctccactctccccaacacagatgttgagacagagtttgcggatgcgaagttcccgcatggggttcctcgtgccgctcgtgccgaatcggcacgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351403 - DNA, 426 bp, Homo sapiens
  misc_feature (14)..(14): n is a, c, g, or t
taggtacgaggctnggtgttcgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggtta

SEQ ID NO: 351404 - DNA, 582 bp, Homo sapiens
  misc_feature (429)..(430): n is a, c, g, or t
  misc_feature (435)..(435): n is a, c, g, or t
  misc_feature (442)..(442): n is a, c, g, or t
gcggccgcctactactactaaattcgcggccgcgtcgaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgtcaataaattgaaatatggttcactgttaaaaaaaaaaaannatatnaaaaaanaaacattgtcgccggctcggcccagtcgactttagaattcggcaaggctatgcatggcgcccgaaatctgggtcacttggcaatttgccctaagggaggcgaatacaaatcactggccggcgtttacaaagttggaatgg

SEQ ID NO: 351405 - DNA, 465 bp, Homo sapiens
  misc_feature (16)..(16): n is a, c, g, or t
  misc_feature (33)..(33): n is a, c, g, or t
agtaaggtccccttcngccccaatgttggggantgaagtttactcaactgagatcaagacgacagaggtgctgatggagaacttccgcagggcccattgggctgcgaataaaggagaccaaggaagtttatgaaggtgaagtcacagagctaactccgtgtgagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggtta

SEQ ID NO: 351406 - DNA, 348 bp, Homo sapiens
ccttgcttctctttacttttccactctaggccacgatgccgcagtaccagacctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggtta

SEQ ID NO: 351407 - DNA, 649 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351408 - DNA, 424 bp, Homo sapiens
  misc_feature (14)..(14): n is a, c, g, or t
taggtacgaggctnggtgttcgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351409 - DNA, 442 bp, Homo sapiens
tgcagaccctgtttaagttgcgatcctcggcactgtggctactggatcttctgcgtgaaccgcttttgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351410 - DNA, 423 bp, Homo sapiens
gcggccgcctactactactaaattcgcggccgcgtcgaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351411 - DNA, 872 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttaaaaaaaaaaaaaaaaaaaaaaaaaaaaaaaaaaaaaaaaaaccaaaaaaaaaaaaaaaacattggcgccccttttcgccacacctctttttaacctgggcaatttttcaatcggcgcgcaaattgcgcccctttgcgccaatccccctaaagggggcggtattaccaataacacggcccggtttccggcgggcttggcccccgggggcccccacctatttccc

SEQ ID NO: 351412 - DNA, 1619 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttaaaaaaaaaaaaaaaaaaaaaaaaaaaaaaaaaaaaaaggggggggccccccaaagatatatccccccgggagggcgcccccaagttcttggcgccgttccccgagttttttctggttcaccaggaggggcccccattagtaagggaggcgagggcttattataaagagcttagaggccagggggcgcgcgggtttttaataacaacggctcggcggatcgggggacaacacgtgtgcgtacacctggtggggggaacctcgtgcggagaaagagaggaacccctcttatctccgcggggggggggggggaaccaattattgggggcggacacaacttatcccctcacacaggagagattttttaaagaggtctctccagggggggacaaattttctaaaaccattttcaacgcggggtgctcacaaagcgtcggtggtctccaaccaccatcacacagtgtgcgcaaaatatatacactgtgtgacccgccgtccctctgacaacaaatttgttggcggccacacaccgcggggaaacttatagagactatctctgtcgggaaaccaccatctttttttttatcacgcgccgggagtacctttcgtggcctatgccacaaacaaaacccgggcgacaaccacacgaacccacggagaacaaagaacaaggcacgcgagaccgccacaggccagaacggcgaaacagcagacaaccaaaccgacccagagaaaccgagcgagagagcgcagggctgagagtccaaccggagcgtgggcgcccaccagaacaagcaagaacagacagcacaaggcagagaacgcgcctgacatacgggcaggaagagagtagcacacgagcaggcgtagccgacaccacaggaggcgacgaccagaggtacacagcacaacacaaaacaaaccaagaacacacaccaccgagctaagacacaacaaaaccaacaaccaaccc

SEQ ID NO: 351413 - DNA, 969 bp, Homo sapiens
  misc_feature (740)..(740): n is a, c, g, or t
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttaaaaaaaaaaaaaaaaaaaaaaaaaaaaaaaaaaaaaaaaaaaaaaaaaaaaaaaaataaaaaaaaaaaaaaaaaaaaaaaaaaaaaaaaancccttgtggcccccttggcccaattgatttttaaattggaccaagttaatccttgcggccgaatttggggctaattggccaatttccccttatggggagcggtttaaacattaatgggccggggtttacaccgctgggacgggaaaaccctggggtcccaattaaacgcctggaaaaatccccttttgcagagtgggtattacgaaaagcccgaccatcgctttccatt

SEQ ID NO: 351414 - DNA, 2512 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgattttagtttggtgagactttttcattttctttaaaggaactgtctgcacaggtgcatgattatgggccatgtgaaccagggtttcttaaaagcaggggaagccagatttaatatttagtgaccaaagggatacagaaagcattttgaaaatgtctcaaaatagttgtttcatgacattaattggtgatcaaaattatctgctgtcattgaggcttcgtagtcccttatttttgaattgttgtcatgtcagaataatgacatggttatcagtaacaaatggaaataattattaaatactaaaagtgtagattagaagaagaaatactaaattgtacttgttttgtattgtgcacttaaagcctatagataagaacggttacagaatttaagcacaaagtgtttttcacattgttttgtaaatgaatctttatactctggtagcatttctcataggaaatgaggcaaagctattgaataacttgctcattgagttgatggccaaactgaaattaaaacctaggagttttgactgcaagtctgggacacggtgaccacaacagcagtttcgtggtatttccatagtgattcattcattcattatttagggatgaaaaattgttgcaagttatgtttttatctttctttgaaacttgaaagggcttgggcaagtaaaacaccattgcaaagttaactgcctgattttaactgtttttggagactggagaaataaatttgaactggaaattttgaaacaccattctaggatcagttctcacatggtacttaagctcacaatgatttatcagggccactgtcagcaatgccgaggataagccgaaaagaacatctttgttctcggcttctgggaatgacttattgtcccgacacttgacctgtaggttttactgaattctcagcacagagcgagcagggaggcagagccgattgagtggaagagggtgcctctggaaaacagcaggttaggagcccttggagtcctccgcctcggagctgtcatcctgctgttggcaagttagggcacctcagttcagtgctgtggcccccaagattaaggtactaggaagtatcctccattacagggaacaggaataaatgaatcaaaaagctatcgggcctttttgacatgggacgaataaagtaactaataggcaaaggggctaaatgatttccagtcaagtaattagagataagtcatttattaaggaggcagatggggtattattggtatatagatggcatagtagattgctagtatattggtagattattggtatatagatggtatgttaaggaggcagatggggtattactggtatatagatggtatggtagattggtagtatattggcagattattggtatatggtatgttgaggcagatggggtattactggtatatagatggcatagtagattggtagtatattggtagattattggtatagagatggtatattattaaggaggcagatggggtaattagaggtgagacttagggacagggcttgtgatatggaaaggagtgaagtcactgagtaaaagacaagtttactgtcagcagagattcttagaggctcttttctccgtgattaaaaaaaaatcctaaaccagtagtataataaacttcctgcctccagcagtgctgggtagctggcaggatgactgtgcccagtgatgaggtgaccccagtcagaccaacttaatgagtatcccactaattagttggatgatgtttgaagctgtcagttaatctcttagttcacatcgttcttgtgagcaaagtgaaggaatcggataagctctaaatttcggtgatgctgctgctctgagagacc

SEQ ID NO: 351415 - DNA, 1148 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgattttagtttggtgagactttttcattttctttaaaggaactgtctgcacaggtgcatgattatgggccatgtgaaccagggtttcttaaaagcaggggaagccagatttaatatttagtgaccaaagggatacagaaagcattttgaaaatgtctcaaaatagttgtttcatgacattaattggtgatcaaaattatctgctgtcattgaggcttcgtagtccttatttgactgctgtcatgtgggatatgacggtatagtacatggattagtttacatattaagtggcatgcaggagaatactactggcggtggtggggctagcatggaagaagtaggattaggcaggtttcatgtggaagacttaacgggattatgagggcagatgaatgtctgtgtggagatacgagcttcacgtaggcaaagggttcctggatctaggagaggggtttggagggaagaaaaacgcttggtggtttgtgatctctgttt

SEQ ID NO: 351416 - DNA, 875 bp, Homo sapiens
  misc_feature (675)..(675): n is a, c, g, or t
  misc_feature (759)..(759): n is a, c, g, or t
  misc_feature (772)..(773): n is a, c, g, or t
  misc_feature (783)..(783): n is a, c, g, or t
  misc_feature (787)..(787): n is a, c, g, or t
  misc_feature (814)..(814): n is a, c, g, or t
  misc_feature (816)..(816): n is a, c, g, or t
  misc_feature (838)..(838): n is a, c, g, or t
  misc_feature (843)..(843): n is a, c, g, or t
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgtcaataaattgaaatatggttcactgttactcttgaaaaaaaaaaaaaaaaaaaatccggnggcatcaatgcgggggggggaaaaagggggtattgagaatggcgcacactggggccaaaagcggtggttcccgggacccacagntttctctgggtgnnaaaggggggnaaantcgggcggggtcccccaaatagggagngncggaataaattccggaaaaccnagggntaacccggggatataaaaaatccggcaaaaga

SEQ ID NO: 351417 - DNA, 929 bp, Homo sapiens
  misc_feature (687)..(687): n is a, c, g, or t
  misc_feature (692)..(693): n is a, c, g, or t
  misc_feature (699)..(699): n is a, c, g, or t
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgtcaataaattgaaatatggttcactgttaaaaaaaaaaaaaaaaaaaagaagaaaaaaaaaaaaaaaaacagnggggnntttttngggggggggagaaaaagagagagaaagagaagaagaggagcgcatagggcgcaaaaaggcggagtgacacatgagcacccacaagttctctcagtggtgcacaccaggggggagaaaaacacacggagaggtcctcctctatgaagggagcgcggtaactaataatgcagaaagacgcgcaggggataaacccggggctatacagtagaacccgccggggacaaccttgt

SEQ ID NO: 351418 - DNA, 896 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggttacaaagaacaagaagagatatacaatagacatacaaggaactacagactccatagataagcaaaaatgaggaaaacacatagcggccatctcttcccgggaggatgggaaacaagaagagacactaggcagagtggccacaggcgaggtgagagccaccgaactgctcagaacaggggctataatacctcgtccccagaaaagggaaggtaaggggcacacagaatgcacatgaggttcggaaaca

SEQ ID NO: 351419 - DNA, 1100 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgtcaataaattgaaatatggttcactgttaaaaaaaaaaaaacaaaaaaaaaaaataaaaaaaaaaaaaagagggggggcgcgccccaaaaaatttcccccggggggccccaatttccgcgctccccgtttttttgtaaaagggggcccccaataggggggcccccttttataagagcgagagggcggggggcgccggcgtttttaaacacacagcgcttgctggggcgggggaacaagccgtggtccacgctcggggctccctggtgggggagaggaacccttaacttctgcgggggggggggaccctctggttgggcgaacaaccatccccctcacgagggattttacgcccccgaggggcgacaatttctcaccctttacggggtggtcttctggggtgttaccccgcgctgtatatcctggcggctggagagtttgggccccgcgactttgtttcggacttttttcccggctgtggttaaagg

SEQ ID NO: 351420 - DNA, 647 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgt

SEQ ID NO: 351421 - DNA, 895 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccaaaaaataaaaaaaaattaaacatataaaaataaatggcgataataaaaaaaaaaaaaaatcaaacaaaaaaaaaaccttgcccggccgcttgggccaagtagattttagattggggcaggtttatgcatgcgccccaatttggagctaatttggccatttcgccctatagggggccgtataacaatcaactggccgccggttaacaacgagcggccttggaaaaaaccctggggttaccaaactaaacggctctgaagaaaatcccctttttgccgggtgcggtaatagggaagaggcccccaccagtcgcctttcc

SEQ ID NO: 351422 - DNA, 1883 bp, Homo sapiens
  misc_feature (14)..(14): n is a, c, g, or t
taggtacgaggctnggtgttcgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctgtaagttatggatttatttagaagaacagttgcatcttaagtttttggagcaccataaagatcaaaataattttagttttgggttctattcattttttagtcagtgtatttggaagttagttattgggatggtataatttaaagcatgcaggttatagaagtcccctggcctaataaaaagaaagtcttcttgggccctgacaagcagaagtaattggcacattgattttcagttcatttagcaatgcttaggtagagagccatcgtatttgaattaaacctgtttcatttgtctgcacaaatcaaataatttggaggatgaactccccacttgtataattgcaattggagttacataacagtccaagagcatgaaaaactacagttctttacatttttatttcccccacaaccactaatgttctcacaaatcactacttcccgaacataataactacaggcacaggcaagggtcctgctgttgtatcaagcaataaaatctgcaagaccccgcagcgaatactgttttgctaatttattatgctttcagagggtttggttcattttacttttccaaagatgttggtgatgtaaagttaaattctcgtgaaataaaaaggtctgtacagttgataagtgtagacttttgtgttccacattataaaagtggtttgatctctaaagtactttcttgacattgttatttcaaaagtaggcaaggcaaattatcagagagatgtttttcagatttaatttttcttgttttgcttttaaaaagcttcagacccataatagcacagaaatgtgataaatattaatcctttggcagcttatggttatgagcaattttacttattggaactgtctcccctaagcacttttcattttcattttgaattagtaaatattttattacaagtctggagatgcagtgttttgaatttagccctttttctaggggctctctgtctaatctcataattctgagtaatgagacctggttttatgttgggttgttttgttttaacagtaagctaacagaaaatcatttagcctcactcggctcagagctgccagactgcatctaatgctgagattttgcaaagtcctgggggtcaggaagtagtgtccgatccccttaaacaaagcattagcccctctctgttatgcccttcagggttacagaccccacctcattagcacaaggagatgttagtgtcttttaaaggcaaagtagtttctttattctgggagagtgtttacttttactcagcaggaaaatgcctgcttgactaagcctgtgtacttgaaccagcactttttacatctgagccacggcaatgtgaatgatagccacagttatacagttcactataaggaagttatttcttatattcatgttgagtttttaagaaaacacagagaactagccagcaacttgcattttctttttcctcctagaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgt

SEQ ID NO: 351423 - DNA, 958 bp, Homo sapiens
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctatttgtattattgctgattacaaaagcaaatcaagagatgagaacccagttgcctgcaagtaaatatttactgcttgacgggtcggagcattttcccattac

SEQ ID NO: 351424 - DNA, 770 bp, Homo sapiens
  misc_feature (14)..(14): n is a, c, g, or t
taggtacgaggctnggtgttcgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatcttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaaaaaaaaaaaaaaacaaaaaaaaaaaaaatttttggggcgcccctggcccccgggaaaaagagttttttaacacccatttcgtttgggcgccgcgcgccccgtttggtgttgtctagacacattgtcatatagcgtgttctccccaaggggagactccgcgggcatatggaatatggtgtgtttggggttctctcccccaagtaaaaaaaagcgcccgggggggaacccgaggtgtgttttgacaaatccccagatggggtctccggggcactcactggctcttctaaccggggtcccaggaagcctttgaataccgccgcagccacgtgtggaggt

SEQ ID NO: 351425 - DNA, 696 bp, Homo sapiens
  misc_feature (14)..(14): n is a, c, g, or t
taggtacgaggctnggtgttcgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatcttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctatttgtattattgctgattacaaaagcaaatcaagagatgagaacccagttgcctgcaagtaaatatttactgcttgacgggtcggagcattttcccattac

SEQ ID NO: 351426 - DNA, 668 bp, Homo sapiens
  misc_feature (468)..(468): n is a, c, g, or t
  misc_feature (552)..(552): n is a, c, g, or t
  misc_feature (565)..(566): n is a, c, g, or t
  misc_feature (576)..(576): n is a, c, g, or t
  misc_feature (580)..(580): n is a, c, g, or t
  misc_feature (607)..(607): n is a, c, g, or t
  misc_feature (609)..(609): n is a, c, g, or t
  misc_feature (631)..(631): n is a, c, g, or t
  misc_feature (636)..(636): n is a, c, g, or t
tgcagaccctgtttaagttgcgatcctcggcactgtggctactggatcttctgcgtgaaccgcttttgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgtcaataaattgaaatatggttcactgttactcttgaaaaaaaaaaaaaaaaaaaatccggnggcatcaatgcgggggggggaaaaagggggtattgagaatggcgcacactggggccaaaagcggtggttcccgggacccacagntttctctgggtgnnaaaggggggnaaantcgggcggggtcccccaaatagggagngncggaataaattccggaaaaccnagggntaacccggggatataaaaaatccggcaaaaga

SEQ ID NO: 351427 - DNA, 565 bp, Homo sapiens
cagagtccaaacagtgcccagagtccaaacagtgcccagagtccaaacagtgctcagagtccaaacagtgcccagatccaaacagtgcccagagtccaaacagtgctcagagtccaaacagtgcccagagtccaaacagtgcccagagtccaaacagtgcccagagtccaaacagtgcccagagtccaaagagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgtta

SEQ ID NO: 351428 - DNA, 791 bp, Homo sapiens
tctccggatgccaaaggatttgacagtgtatctagctttggaaacacagggggtctgccctgtgagctgctccaacaccttggctgctcgcgtcagtctgtctccactctccccaacacagatgttgagacagagtttgcggatgcgaagttcccgcatggggttcctcgtgccgctcgtgccgaatcggcacgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttaaaaaaaaaaaaaaaaaaaaaaaaaaaaaaaaaaaaaaaaaaccaaaaaaaaaaaaaaaacattggcgccccttttcgccacacctctttttaacctgggcaatttttcaatcggcgcgcaaattgcgcccctttgcgccaatccccctaaagggggcggtattaccaataacacggcccggtttccggcgggcttggcccccgggggcccccacctatttccc

SEQ ID NO: 351429 - DNA, 721 bp, Homo sapiens
  misc_feature (674)..(674): n is a, c, g, or t
  misc_feature (718)..(718): n is a, c, g, or t
  misc_feature (721)..(721): n is a, c, g, or t
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggttattactccttaaacaaaaaaaccnaaaacaaacacacccccacccccctcaccccaaaaaaacaaaanaan

SEQ ID NO: 351430 - DNA, 1019 bp, Homo sapiens
  misc_feature (750)..(750): n is a, c, g, or t
  misc_feature (752)..(752): n is a, c, g, or t
  misc_feature (754)..(754): n is a, c, g, or t
cttcgacatctagctccaggtccccattcttctatgaagacttccttgatcatgccaatataataatctcttccctttgggttcatggcctgtatcaaatgattctataaatcacagatcctagtctcttttttttttcttttttttagagtctgagtctcactctgttatccaggctgaagtacgatggcatgatctcagctcactgtaaccttcgcctcctgggctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattggacaatgtcaataaattgaaatatggttcactggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaananangggggggggaggaggacgaaaaggccgaggggggagagaaaccaggacagggacacaccagaagaagacagacgacagacgggaggaaaaagaagcgagagggagagaaaaaagagagagggaggagaaaaggagagggaggaagaagagcgagagggagatgggggtgggaaagtgaggaggaaggggaaaaatgaggaacgaagaggaaaacgagagggataggggacaagatgaaaagaggggaaagacgcgcgaaggagac

SEQ ID NO: 351431 - DNA, 238 bp, Homo sapiens
gcgtggtaccactgcagggtgggtaagggagatggaggtctctccaggagatgggtgaggaaactgtctcctaaccacttcctccggcaccacctgcccataaagtgcatgcccccggcagcaccttcccataaatcacatttgcggccacctttcaaagcactgactcggaggccaacgccaacaaaagcttttgtagcataaaatgattgggacaaatcatagccaaactaaaaac

SEQ ID NO: 351432 - DNA, 1266 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggacgctggggcacagacaggtggagcgacgtactgaggttgcccactgcaggggcgactgtctccaacactacctcaggcgactagaa

SEQ ID NO: 351433 - DNA, 3164 bp, Homo sapiens
gggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351434 - DNA, 3573 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351435 - DNA, 2859 bp, Homo sapiens
tcggaactgaggccatgattaagagggctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351436 - DNA, 3361 bp, Homo sapiens
ggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351437 - DNA, 3483 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaaaaaaaaacaaaaaaaacaacaaaaaaaaaccatttggggggggcgtgggcccttggggaaaaaagtttttaagaccccattcggtttggggggggggggcccacagaagtgttaggcgaacccatggcgccacaagacgcgtggtccccaaaaagaagaaacccggggtcacagaccaagaggtggttggggagtttctcacagccaaaattaaaaaaaagaggcgccggggggagacacacgacgaacgcggtcgtggaacacacaccccaacaaagagcaggagttccgagagcggccatacacgggcgtctctatccacaccaggggaggtcacaggcggagcgctgaggattaattaaaattaaccacggcccaggcggagtgggagacgaccaggtccgccgtggacgagtagcgaacacaagacgagtaaagaacgagcgcaagcagcgacaggacgaggaaacagaggagactcgcgccgcgcgggcagagaggagaaagcaacacgcgacatcgggcgagcgaacgagcccacgagggaacgacgagaggacgcagcgccaagagagacgtgagcaaacgaaagcacgaccgacggaaggcggagagagcaacactcagcacgcgagcagagagaagaaggagcaaaagccgggcggaacccacgacggaacgtaagcagagccacaagcaagagaaagcgacagacgaagaaacggacagttgacgagcaggcgatagagcgcgaagagccc

SEQ ID NO: 351438 - DNA, 2734 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351439 - DNA, 773 bp, Homo sapiens
tggacagcgacagcacagaggaggtggacagcacagaggaggtggacagcacagagggttggacagcacagaggaggtggacagcgcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351440 - DNA, 357 bp, Homo sapiens
ggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaa

SEQ ID NO: 351441 - DNA, 3923 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351442 - DNA, 2722 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaa

SEQ ID NO: 351443 - DNA, 3963 bp, Homo sapiens
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcagaaaaaaaaaaacaacaacaatacaagcgcaacacacaaca

SEQ ID NO: 351444 - DNA, 3331 bp, Homo sapiens
gtatgcagtgggcgtctgtacaccgtctgtgctgggcaacctgtgagacatgttccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351445 - DNA, 3633 bp, Homo sapiens
  misc_feature (1406)..(1406): n is a, c, g, or t
  misc_feature (1416)..(1416): n is a, c, g, or t
ggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggaggnggtgcggggntcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaagcag

SEQ ID NO: 351446 - DNA, 2482 bp, Homo sapiens
  misc_feature (2267)..(2267): n is a, c, g, or t
tagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaagcgcttgtgtactacngagccgctggtcctacagagcaagcagccttaccggttggtagcccccgctgtgcctggcggctggagccggcccactggcgccctgtgcgccccctctcggcccctgtggttccctgtcccagtggccctgtttgccgcatggcccgggtccttgccgaacccgttccgccctgggcggtccttgccaccgttcccactcccaggcggtcccca

SEQ ID NO: 351447 - DNA, 273 bp, Homo sapiens
cccagggcctggcacatgagacagaagtgggggtgcacagagggccggaaggatgctgggacccctgtcagctctgcttctcttccccttctgccccttcagcccctccttgtcactgcagtgtaacctgtggtcccctgcaagaccaccagacacttagctgaggcccccacttcttattgacaggcaaagcagcaccagggcctgttctttcccatggagcagctctgtagcccatgccccctcctctccaggggccccctcccagccctg

SEQ ID NO: 351448 - DNA, 780 bp, Homo sapiens
ccgagtacctgggattacaggcatgtgccaccatgcctggctaattttgtatttttagtagagatggggtttctccatgttggtcaggctggtttcgaactcctgatctcaggtgatccgccagcctcagcctcccaaagtgtcaggattataggtgtgagccactgtgcctggcctggggttaatttttgaaagcaagttataaaatggaaagcactataattttactctttgaaaatacatcgagaaaatactggaattatgtgcatcaaaatggatggtgagagtatagctgtttttaaattttctttgtacttgtatttctcaacttttatagtaataatagctaacatttactgagaactaagcacttacatatggtattttattcgaaaactctttgaggtaaatattactattattttcattatggagtttcagaaactagaaccagaagggtaactcatccatggtcacacagccactaagtgctggaatcaagtgttgaattcaggtcggtggctaaagtctatgcatctctgtcactactgtctaccatctccctgcacatgtattattattattttaattataaggaataagtagaaaaggaaagggaaaatgtttcatgctttagtaagaactgtgcctggcctggggttaatttttgaaagcaagttataaaatggaaagcactataattttactctttgaaaatacatcgagaaaatactggaattatgtgcatcaaaatggatggtgagagtatagctgttttta

SEQ ID NO: 351449 - DNA, 1314 bp, Homo sapiens
ctctcgcacgcggggactgagcacggcccgaaaagccgaggacagccggactcaccctgtagttatagtagtgcgtctgcacaagatgccggtggcgcgacttgtggttgccgaagttggatttctcgcaaaccaagatggggtcttgctgtgttgcccagactggtctcaaactcctgagctcaagtgatccacccaccgtggcctcccaaagtgctgagattaaaggctacccatggggacctcaacagctttgccattgcacactatctttgcagacaagatcttaatcacatccaactttctgcagttgcacagggtacctcagacccacatcccagatgacattcctcagaagctcgcagctggagatgacatcaccttagacaacatcaccctagcccaagacatcgctattagagatacatcacctggacactaaagcctccaccccagtgacactctcaaggtgctgacaaaatggacatggacatttgttgcttttcttctttttgaattaggaactctattgtgtttcctgaatttactgtctgcttggcccatgatcctggtatgttccttgctctctgccaaaacatgcaccgtcccctccacacctaaaggaaaacctggtagaagctactactctcaatgccattctaaaattgacgaagagtattattttccccaagaggcagctgctgcaggccagtgaatcctctggaccctggggagagggtcatacactccctagtgacttctactctatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagaaaccctggaaatttcaaatctatttcgtctgctaatgccatgtgaatgggaaacttagatacaggctggcctacaaggactccttatacttcaatttttgttcctcctttcaactctcataaaaaatattttctatactatttagggcaaatgatggccttctttctaagtctcatccatcattgctgcaaaggtgccttagtttgatgttaaagtgtcacagggccaatgtattgaccatgtttctggcgtctataaagtcgatgttttaatatctgtcc

SEQ ID NO: 351450 - DNA, 1316 bp, Homo sapiens
aggaatagagtgtgccaacagcttagatatagagtgtgagagagaagagtggaggctggttctcaggctccagaagcataagcctgcatggagcatagcgtcactgagcaagacaggtgtggaggatgagaagcgggccacaggatgggaagggaatctgtgtggaggcggtgccctaaacatgctgccttgaggagggacctctacatggggtggccgggcacagccaggctacccatggggacctcaacagctttgccattgcacactatctttgcagacaagatcttaatcacatccaactttctgcagttgcacagggtacctcagacccacatcccagatgacattcctcagaagctcgcagctggagatgacatcaccttagacaacatcaccctagcccaagacatcgctattagagatacatcacctggacactaaagcctccaccccagtgacactctcaaggtgctgacaaaatggacatggacatttgttgcttttcttctttttgaattaggaactctattgtgtttcctgaatttactgtctgcttggcccatgatcctggtatgttccttgctctctgccaaaacatgcaccgtcccctccacacctaaaggaaaacctggtagaagctactactctcaatgccattctaaaattgacgaagagtattattttccccaagaggcagctgctgcaggccagtgaatcctctggaccctggggagagggtcatacactccctagtgacttctactctatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagaaaccctggaaatttcaaatctatttcgtctgctaatgccatgtgaatgggaaacttagatacaggctggcctacaaggactccttatacttcaatttttgttcctcctttcaactctcataaaaaatattttctatactatttagggcaaatgatggccttctttctaagtctcatccatcattgctgcaaaggtgccttagtttgatgttaaagtgtcacagggccaatgtattgaccatgtttctggcgtctataaagtcgatgttttaatatctgtcc

SEQ ID NO: 351451 - DNA, 1234 bp, Homo sapiens
aggaatagagtgtgccaacagcttagatatagagtgtgagagagaagagtggaggctggttctcaggctccagaagcataagcctgcatggagcatagcgtcactgagcaagacaggtgtggaggatgagaagcgggccacaggatgggaagggaatctgtgtggaggcggtgccctaaacatgctgccttgaggagggacctctacatggggtggccgggcacagccagttgcacagggtacctcagacccacatcccagatgacattcctcagaagctcgcagctggagatgacatcaccttagacaacatcaccctagcccaagacatcgctattagagatacatcacctggacactaaagcctccaccccagtgacactctcaaggtgctgacaaaatggacatggacatttgttgcttttcttctttttgaattaggaactctattgtgtttcctgaatttactgtctgcttggcccatgatcctggtatgttccttgctctctgccaaaacatgcaccgtcccctccacacctaaaggaaaacctggtagaagctactactctcaatgccattctaaaattgacgaagagtattattttccccaagaggcagctgctgcaggccagtgaatcctctggaccctggggagagggtcatacactccctagtgacttctactctatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagaaaccctggaaatttcaaatctatttcgtctgctaatgccatgtgaatgggaaacttagatacaggctggcctacaaggactccttatacttcaatttttgttcctcctttcaactctcataaaaaatattttctatactatttagggcaaatgatggccttctttctaagtctcatccatcattgctgcaaaggtgccttagtttgatgttaaagtgtcacagggccaatgtattgaccatgtttctggcgtctataaagtcgatgttttaatatctgtcc

SEQ ID NO: 351452 - DNA, 1232 bp, Homo sapiens
ctctcgcacgcggggactgagcacggcccgaaaagccgaggacagccggactcaccctgtagttatagtagtgcgtctgcacaagatgccggtggcgcgacttgtggttgccgaagttggatttctcgcaaaccaagatggggtcttgctgtgttgcccagactggtctcaaactcctgagctcaagtgatccacccaccgtggcctcccaaagtgctgagattaaagttgcacagggtacctcagacccacatcccagatgacattcctcagaagctcgcagctggagatgacatcaccttagacaacatcaccctagcccaagacatcgctattagagatacatcacctggacactaaagcctccaccccagtgacactctcaaggtgctgacaaaatggacatggacatttgttgcttttcttctttttgaattaggaactctattgtgtttcctgaatttactgtctgcttggcccatgatcctggtatgttccttgctctctgccaaaacatgcaccgtcccctccacacctaaaggaaaacctggtagaagctactactctcaatgccattctaaaattgacgaagagtattattttccccaagaggcagctgctgcaggccagtgaatcctctggaccctggggagagggtcatacactccctagtgacttctactctatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagaaaccctggaaatttcaaatctatttcgtctgctaatgccatgtgaatgggaaacttagatacaggctggcctacaaggactccttatacttcaatttttgttcctcctttcaactctcataaaaaatattttctatactatttagggcaaatgatggccttctttctaagtctcatccatcattgctgcaaaggtgccttagtttgatgttaaagtgtcacagggccaatgtattgaccatgtttctggcgtctataaagtcgatgttttaatatctgtcc

SEQ ID NO: 351453 - DNA, 553 bp, Homo sapiens
aggaatagagtgtgccaacagcttagatatagagtgtgagagagaagagtggaggctggttctcaggctccagaagcataagcctgcatggagcatagcgtcactgagcaagacaggtgtggaggatgagaagcgggccacaggatgggaagggaatctgtgtggaggcggtgccctaaacatgctgccttgaggagggacctctacatggggtggccgggcacagccagatgtccctggagacagcgccatctggtggaacttcctgtaacgatcgagatgttccgtctgtgccgtccaacatgggagccatgcaggacacatggtgactgagcactgggactgtgtgccgcgtgaccaagagcagctcagctctaaagtctcctccagctttatgatgtcacttcctgtatcttctctacacattctttccttcagcctgttgtttgtaagtttttatgtaggaaagtagaaaattcagaatatgtttcatcaggtttttgtttggcaaagtgtcaacatgtttataacagagttaaagataaaggaaacc

SEQ ID NO: 351454 - DNA, 759 bp, Homo sapiens
gcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaacaaaaaaaaaaaaaaaaaaaaacacaacaaaaaatcagacaacaaacacaaacaacaataaaacacaaaagaaagagggggggggagcccataaataccaccccggggggggcacccattccaggcaccccgcggtttttcgaacagggggcccccaccataggggcgcactatacg

SEQ ID NO: 351455 - DNA, 483 bp, Homo sapiens
ggtctactggagtttgctggaggtccacgccagaccgtttgcccggatatcaccagcggaagctacagaacagcaaagattgttgcctgtcccttcctctggaagttttgccccagagggtcacccaccagatgccagccagagctctcctgtatgaggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaacaaa

SEQ ID NO: 351456 - DNA, 586 bp, Homo sapiens
gcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaacaaa

SEQ ID NO: 351457 - DNA, 523 bp, Homo sapiens
gcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaacaaa

SEQ ID NO: 351458 - DNA, 3067 bp, Homo sapiens
agcggggcgccaccacgtgtgtccctgcgcccggtggccaccgactcagtccctcgccgaccagtctgggcagcggaggagggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtccggggtgtgtgtgtgtgtttgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351459 - DNA, 648 bp, Homo sapiens
tacagagtgaatgttattatatctagagaggcagtttgatttccattttatgctgatttgttatataaataattatataaatttattttcattcaaaccagttcactaaaatgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351460 - DNA, 664 bp, Homo sapiens
cccttcaggacgtaagtatctcagtgcctggtacagggctcaactacagtatgggtgctctgactaatctattaaataaattgtctgtgttgaattatctcaaccttaaaggcaatactaagaagaatgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351461 - DNA, 3046 bp, Homo sapiens
aaaagatgtgactacgtgcgtccgggtgtattagtgaggggacagtctggcttagatgatggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtccggggtgtgtgtgtgtgtttgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351462 - DNA, 3036 bp, Homo sapiens
agcggggcgccaccacgtgtgtccctgcgcccggtggccaccgactcagtccctcgccgaccagtctgggcagcggaggagggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtccgggtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351463 - DNA, 2340 bp, Homo sapiens
agcggggcgccaccacgtgtgtccctgcgcccggtggccaccgactcagtccctcgccgaccagtctgggcagcggaggagggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtccggggtgtgtgtgtgtgtttgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351464 - DNA, 883 bp, Homo sapiens
gctttgcttaggccaagtcctgtctcttgggactcaaaattcccatctctcatacttcttaatgaaaattacttatggaggcttctctgagagaagtctgctaagctgccagcccaaatcttgtttaatcttttgataacagatgctcttatttgctgacctgtcctaccaagtctttcaccagtcaaatttgcatttgaattcttttttttatcttagtcatattctcagttttaccactgcatcataaaatagtcaaaaggtgggagaaggaggatggacaaaataattaaatttgaactggttctctgaaaactcaaaataagaattgattagatctctgcacatatatgtgcctgctcaatatgtgaagtacaggagaagctgctgtcaagctcagctgttggatccttaaggttgcccttggttttggtgtaagaatgtgagtttagtggttcagttccatttttgccttccacatgaaggtgccattagggtctttatgaaaatgtgcaacacaatttattcttaagccccaagggtcatcttatctttgattatctggcctagcttggagatgaccagggaaaggagggaatgtatagatccccaaatatggaaaagctcttcccccctccttactcttttttctaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcac

SEQ ID NO: 351465 - DNA, 2065 bp, Homo sapiens
  misc_feature (279)..(279): n is a, c, g, or t
  misc_feature (1895)..(1895): n is a, c, g, or t
  misc_feature (1907)..(1907): n is a, c, g, or t
  misc_feature (1911)..(1911): n is a, c, g, or t
  misc_feature (1916)..(1917): n is a, c, g, or t
  misc_feature (1925)..(1926): n is a, c, g, or t
  misc_feature (1930)..(1930): n is a, c, g, or t
  misc_feature (1937)..(1937): n is a, c, g, or t
  misc_feature (1940)..(1940): n is a, c, g, or t
  misc_feature (1949)..(1949): n is a, c, g, or t
  misc_feature (1957)..(1958): n is a, c, g, or t
  misc_feature (1964)..(1966): n is a, c, g, or t
  misc_feature (1971)..(1972): n is a, c, g, or t
  misc_feature (1974)..(1974): n is a, c, g, or t
  misc_feature (1982)..(1982): n is a, c, g, or t
  misc_feature (1988)..(1988): n is a, c, g, or t
  misc_feature (1992)..(1992): n is a, c, g, or t
  misc_feature (2006)..(2006): n is a, c, g, or t
  misc_feature (2012)..(2012): n is a, c, g, or t
  misc_feature (2016)..(2016): n is a, c, g, or t
  misc_feature (2023)..(2023): n is a, c, g, or t
  misc_feature (2025)..(2025): n is a, c, g, or t
  misc_feature (2044)..(2044): n is a, c, g, or t
  misc_feature (2050)..(2051): n is a, c, g, or t
  misc_feature (2056)..(2056): n is a, c, g, or t
  misc_feature (2064)..(2065): n is a, c, g, or t
atgtaaggcaaattttgcaaattgcaaattttgcaaatgcaaaaattacaggtgtgagccagtgcgcccagccatatataacattttaaatctcagctacaaagtgttttcacatacatattctcaactgatttttataatcaatttgagatgcattgtcagtttcattttacaaatggaaaaaaaggaagctgaggcaaaggtcaggcagtgaaaccaaagcatcacagccagtagatcaagctgtagggtgggatccaagtcttcgtttctctcgtnctactgtgttgcagcatgctgtcaagaggatgcagtcctggtcggatctttaacaggaatgatgatggtggtgctggaattgttggccctttttctgctctgctcctatgtaacatcttcttggtttttgttcctttccctccccttctgtttctttcagcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagtggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaataatttagatgtttaaggttccttccagatcaaaagttttccaacatggagtcagtcccaggtagacatagccaggagcagagaagagggagaaaggaagaaaataccattacatccggaagcgagagatgaattttgaatccaggtggggcaaagaatgggtaggaaagttagaagctcaggaaataagcaaatttgtatcagattgaaggtaactagcactcatgtctggaaaataataactttattttttccaaatgattttaactttactccttatatcaattattcaagttttccatcagaacctcaagcagaatataaaatttatcctttattttcaaatcctttttgatttaatgtaattttcatgagatgatgaccaacttgagttgttcctcctagtgtcctctcatgcatgattacatttagccttcatgataagcctgtgaagtccgtctctactnaaaatataaaanttanctggnnatggtggnncacncctgtantcncagctactngggaggcnnaggcannngaatnncntgaacccnggaggnagangttgcagtgagccnagatcntgcnactgcantncagcctgggtgacagagcnagactnngtctnaaaaaacnn

SEQ ID NO: 351466 - DNA, 2247 bp, Homo sapiens
tctagaggatccagtggacgatgtgcagaaggagagcaaatgttatccccaagacaatggggaaaatgtctccaggccatgtcagaggccttcacggcagctccctcatggaagatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtccggggtgtgtgtgtgtgtttgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagtcccatattttctccattgggccttcttatgtatttcaagattattctgtgcactttaaatttacttaacttaccataaatgcagtgtgacttttcccacacagtggattgtgaggctcttaacttcttaaaagtataggggcatcttgtgaatcctataagcagtctttatgtctcttaacattcacacctatttttaaaaacaaatattattactatttttattattggttgtcctttataaattttcttaaagattaagaaaatttaagaccccattgagttactgtaatgcaattcaactttgagttatcttttaaatatgtcttgtatagttcatattcatggctgaaacttgaccacactattgctgattg

SEQ ID NO: 351467 - DNA, 2347 bp, Homo sapiens
agcggggcgccaccacgtgtgtccctgcgcccggtggccaccgactcagtccctcgccgaccagtctgggcagcggaggagggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgtctcctgaggagctcctcagcagacgcagctcacacgtagaaaatacccccattatctcatttggcca

SEQ ID NO: 351468 - DNA, 940 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaatt

SEQ ID NO: 351469 - DNA, 525 bp, Homo sapiens
  misc_feature (2)..(2): n is a, c, g, or t
  misc_feature (26)..(26): n is a, c, g, or t
  misc_feature (42)..(42): n is a, c, g, or t
  misc_feature (57)..(57): n is a, c, g, or t
  misc_feature (70)..(70): n is a, c, g, or t
  misc_feature (91)..(91): n is a, c, g, or t
anggaaaaaaaaaggggaaaattttncccctttttttaaagnaaagggggttttttnggaaaaaaggggnccccccccaaacccccttttnccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351470 - DNA, 2291 bp, Homo sapiens
cgacccacgcgtccggacccacgcgtccgggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351471 - DNA, 2257 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggttttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351472 - DNA, 2253 bp, Homo sapiens
catactggggggaaaagcgcaatactattgcttccattgctgctggtgtactattttttacaggctggtggattatcatagatgcagctgttatttatccgcaccgaatggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351473 - DNA, 2401 bp, Homo sapiens
atttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaatgtattaaaagggatctcctcacttaaataccttgcttttagccagtgagatacagaattgctatgatttctcattggtatcacctttgttttagttttttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351474 - DNA, 1980 bp, Homo sapiens
  misc_feature (4)..(4): n is a, c, g, or t
  misc_feature (7)..(7): n is a, c, g, or t
  misc_feature (23)..(23): n is a, c, g, or t
ggtnagnaattcccgaggtcaanccacgcgtgcgggtgttataacaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351475 - DNA, 2205 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351476 - DNA, 1427 bp, Homo sapiens
tcaagcttctaacgatgtacggggacatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351477 - DNA, 934 bp, Homo sapiens
aacaggctggtccccggtacgggatccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351478 - DNA, 640 bp, Homo sapiens
acccagtttattatcagaacaactacaaagaaattgtcccctgtctaagactggagtgtcaagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351479 - DNA, 847 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaatt

SEQ ID NO: 351480 - DNA, 579 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351481 - DNA, 2298 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351482 - DNA, 2213 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaacttta

SEQ ID NO: 351483 - DNA, 2445 bp, Homo sapiens
agctggggccgtctgacgggctggtgcccacagggtcgttgccgccacccaccggcaagtcgcagacccggcctgagcctccctggacccttcctggcctcttcctcctgtcctaggtaccgcggcgccaggagaaggcgaccgcgtccacaccccgccatgacagagaggggacctcaccctcccccggaacaccccaagacccctggaaaatcccccgatcccccacttcacagctggacaagccgaagccccgagaaaagagcgtgacccggccagctccctcagcgaggggtgccccggctaaagtgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351484 - DNA, 2237 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactctt

SEQ ID NO: 351485 - DNA, 937 bp, Homo sapiens
agcgggtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaagagccaaatctatggggatgcacctggagtacgtttaaacggtcaaggagacttcactgaaactaaccccggcacatctacccgggcataactgggcagataacagcaacttcgcgcacacacacacgg

SEQ ID NO: 351486 - DNA, 1031 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaagtaaagtaaaccttttaaagcaattttactaagctgtctttagaattcactttacggcgtttcagaatattaagttctgcttttggactggtgcatttagagaccagcacaagcaagagtctggaaaatcctttaaaacttcagtattaactggttatacccgaaggcaaacaaatgcagtttggcttcacaaaagcaacattccagttctgatacagtctcaagtaacttttctaggcacatatgcatgctttcttgtttaccaggaacaaatagggtgatgattatgcatgagcttctagcgtattgtcatctggttctaaatgaactaaaagcaaaatatagtttttttgagtttttaaggtacaagagactgtgtggaatttggatatttaagaaatagctccccagtgttcttttatttctattaaactttgcccaggtttttcattttatatatgtagttttagctaatgttatttttttctttttaaaaattaatatctttcctcttgcctactatttatttttttattttccatcccaatattctttaa

SEQ ID NO: 351487 - DNA, 5900 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgcttttttatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattatttttgttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaagttt

SEQ ID NO: 351488 - DNA, 4247 bp, Homo sapiens
  misc_feature (4214)..(4214): n is a, c, g, or t
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatgggtctctgcattttaattttangaaacacaaacctgggtcacaaaacatcttcag

SEQ ID NO: 351489 - DNA, 4299 bp, Homo sapiens
ttacatatcgtcccatcatctctcaagttattcgcctttgggaaggaaaaagctccccatggcagtgagcctgtacactgccttaatcctgtctcccacagccatcaggaaatagtagtgagcagtattaatgccatataaaagaccagttaatataacatagtaccaaatccatttttaaccgagagggactttactgatgggagcaagaccttcgtcccatcagtatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattatttttgttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaagttt

SEQ ID NO: 351490 - DNA, 2380 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatgcgcgctcttctcccatcagcggattgcctaatcttcacaaggtgttcatttcctgtctcacccagctagccaccttctgcatttttattttgttgatctttactgcctgaatttccatggggattccttattgtaaacatgttctttgctcacacctctgtacataac

SEQ ID NO: 351491 - DNA, 985 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagagctttatggatattggaacattgatatgggatggtggacctgtacctaacacacaagagtgatacagataaattatctttggcataacggggatggccgggtgcagtggtttatgcctataatcccagcactttggaaggctgagatgggaggatcatttgaggcccgaatttcaagactagcctcagccccaaataacaagagccccatctatatcaaaaataaataaatattgacatttaaaccataaaaaaaaaaaaaaaaaatcgagttaaagagaagcggggggaacacgccatgtcaactccgttaataaacaacaaccccgggggtgcccacaatattttttggtcggcccaagagccaatgatgaataggacgttcggagtaaaaacacaaacacagaagacgagctccccacaacaacttaattattattcaaggtacacagaatctacgaaaaacaggccccaccacaagtggggagtgtcggtcctcacaaaaacattgtgtctcgggtccacgcaagagtaggcgcggaatacagctccgtaaaaccaccccgagtgcgcgcagggtccacgacctcgatcctgggcagcccactacctatcaatctctcatgtagcaatgtagcgactaatctgctccactgt

SEQ ID NO: 351492 - DNA, 5955 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattatttttgttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaagttt

SEQ ID NO: 351493 - DNA, 5901 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattatttttgttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaaaaaaaagttt

SEQ ID NO: 351494 - DNA, 5971 bp, Homo sapiens
ggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccattgaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaagcagtgcttaagagaaaatacaattttaattattttgttgagcctgcagagtagtaagtttttaaaaatataagttcatagcattttaattaactttgaaagttcatatgcatcagaaaatttatgaaaatttgaatgaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatattatttttgttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctccacctcctcctcctcctcttggatctagttgaaggtccccggttgagtcatgaagcgagactggggcggccgc

SEQ ID NO: 351495 - DNA, 1303 bp, Homo sapiens
  misc_feature (4)..(4): n is a, c, g, or t
  misc_feature (1278)..(1278): n is a, c, g, or t
  misc_feature (1300)..(1300): n is a, c, g, or t
ggcngaggggctcactctgcaaccaaggcacgtgcattccggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcgggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgctgaatcaaggcatctgtgactggcattgaggtgcgcgcgcaaaaactgacanagtcatcactggcgctgaatgnttc

SEQ ID NO: 351496 - DNA, 655 bp, Homo sapiens
gagctctggccggcggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactgtatatctgtttttctcgagttttcttcttgcagtgctctttcaatctcattggacatattttatattattttcctgcttaagcactgggggttgggtggaaggatctgtggctcatcataggcaatttccacacttttaaggt

SEQ ID NO: 351497 - DNA, 2721 bp, Homo sapiens
  misc_feature (4)..(4): n is a, c, g, or t
ggcngaggggctcactctgcaaccaaggcacgtgcattccggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcgggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgaggctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagcttttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagca

SEQ ID NO: 351498 - DNA, 2258 bp, Homo sapiens
  misc_feature (4)..(4): n is a, c, g, or t
ggcngaggggctcactctgcaaccaaggcacgtgcattccggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcgggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagcttttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcaccccctcggcttctgctttttagtgaatggcatgactgactatccgggtggtaagccacccaggtgcctaagcaagagactgagggaaacagctgtgcgagttttataaagttttatactaaaagaatttttactggatctctatcatctacatgcatatctgggagtttctata

SEQ ID NO: 351499 - DNA, 983 bp, Homo sapiens
gagctctggccggcggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagca

SEQ ID NO: 351500 - DNA, 2451 bp, Homo sapiens
  misc_feature (4)..(4): n is a, c, g, or t
ggcngaggggctcactctgcaaccaaggcacgtgcattccggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcgggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagcttttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagca

SEQ ID NO: 351501 - DNA, 3113 bp, Homo sapiens
  misc_feature (4)..(4): n is a, c, g, or t
ggcngaggggctcactctgcaaccaaggcacgtgcattccggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcgggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagcttttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaaaaaaaaaaaaaaaaacatgggggtggccgcgcgcccgcgcggcccccggaaaaaagttttaaaaaaccccgcgtgtgtggggcgcggcggggccccaggggggtaaggggcacacgggggccacaaaggcgggttccccaaagggaaaacaccggggcccgaggaaacacaaggtgggcggtgggtctctcctacccaaaaaataaaaaaaccgccggggggggaaccaccgagcgcgttttggacacaaccccgaagggcgggccctcgaggagggacaaacacggggagcttcataaacacacgggagccccaagggcgagcccgaataataaaaattagcccgcgccggagagagaagtaaaccaacgagacaacaacatacacaaacactagcacactacacactaaaagactaatagagagaacgtaaccgccagacgacggaaaataaaccaaacatcaaaaacagctagggcgacaggagccagccggaagaagaacaggaaggccgaagaaaacagatgagagagagagaagagcagagagagaagcctaacacgaagagaaaaatggagtacaaaaagcaccacgaaaagcagagaagaacaacgaaacaacgagagaaagaaacatcaaaacgaaatacatactacacacagcaagatggaagaaaacaataacagaaacgaaaacataacaggaacagcccagacacagcagacacagcaggcacgacacaccacaacaacagagaagaaac

SEQ ID NO: 351502 - DNA, 1457 bp, Homo sapiens
gggctgctatggctgctgactgatagcgaggtggcgaagcctcccagtcttgcacgcacttgcgtgagaagctgccgaagtggacgagacattcccacgctgcacctcggtcgtggcacagtgtccaggctcgacgttactgttgtctgtctctaagatccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagcttttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagca

SEQ ID NO: 351503 - DNA, 2152 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351504 - DNA, 1607 bp, Homo sapiens
  misc_feature (1574)..(1574): n is a, c, g, or t
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggtcagancataaggtttatcctcaagagtcagccatgacg

SEQ ID NO: 351505 - DNA, 702 bp, Homo sapiens
gcccaggcagagcttcccccggaaggattgcataggccagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggtaagtgacctttggctgttggagaaaattttttacttcatcgggaataggtgaccttttgtttctttgaaagagatact

SEQ ID NO: 351506 - DNA, 566 bp, Homo sapiens
atttctagcaacttttattcaatctttccaaggccctcgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtggtacgttgcagttcacctgggatttgatgaagagaagggccagcttgctctggctgactttaaacctcccgtgaaaagccgtgttggtgtacttgagtcattccaggtatatggcaagttttaataattcactggtctgccttgccttttttccccacagaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacattta

SEQ ID NO: 351507 - DNA, 635 bp, Homo sapiens
gagcgcaatcaggtatgtcaatctgaagcgagggatcaacaatcaggtccacagatacagatctcagctgaaatacattttttgcgtattagtctcaaactcatttggccctaaaaaattattcccaaaatgagtagttacttaaaagcagtttatacatagatcatttagaaatgtcagttgaactgggttgggtggctcacacctgtaatcctagcacttcgggaggacaagatgggcagatcgtttgagcctgggcaacatggcaaaattatctaaaagtcgtggttaccagttaacttctttctttctttacagaccacactgcccacgtttcagagcccagagttttctgttacaaggcaacatgaagactttgtgtggctacatgacactcttattgaaacaacagactatgctgggcttattgtgagtcttttagaaaatcaaataagctagttctttctgccttgctatgcattagtttaaaagagacttatatccactttttttaatggattgtgaaaagttagatttcatctacctactggagtatttgctgactgtcaagtggaaagtatgtgaaggaatagtgttacagctttgaggtggtgcatacaggcttacattattta

SEQ ID NO: 351508 - DNA, 2394 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351509 - DNA, 2069 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351510 - DNA, 3101 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351511 - DNA, 2289 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351512 - DNA, 2493 bp, Homo sapiens
  misc_feature (2197)..(2197): n is a, c, g, or t
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaaaaaaaaaaaaaaaaaaaaaaaaaaaaaaaaaaaaaaaaaaaaaanaaaaaaaaaaaaaaaaaaaaaaggggggggggggcaagaataaaccagtccgccgcgcggggggtccccacggcgaccgcaccgccccacagtgtattaaaaagagagtagaaagggaggaactcacaccgggagggaggtccaattaataaaagagcggggcagcggggcgcgtgagaacaaaaaaaaacggggagacacagggacacacacgccgcactccgtggaatttgagggagagaacacacacgcacgcggggagagaagacacgttcataggcggacaaccacacagg

SEQ ID NO: 351513 - DNA, 1545 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacattta

SEQ ID NO: 351514 - DNA, 4400 bp, Homo sapiens
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaataggtgaggaaatgcacagggattccgtaactacttttctccttttagagaagtgccttggctctcttaccaaaagcactgcgattttttaaaacagttgaaaatgtgctttccaaatgaagccgtgcttgtttaccgtgaaggctgattataatccgtattgtaaggattgacctggtagggaagtacatcatgaactgaaactttacctaaaactttggatacgtgatccagtagtttcaagggaaatctacaaaagtcaggtttttaaaaattttttaaaaattctgaaatagagatgaggtctcaccgttttgctcagcctgggcaacagagcaagattccgtctcaagaaaaaaaaaaaaaaggagtagatgaaaaggaagcatgccctaaagatcatcaagtaaacctgtcttgaatacgtgtagcagtttttcactgttttggatttaaaaatgttttaagttttatttttaatcgacaagtcattgtattgcatttgtggaatacagtgtgatgctttgcaggtacataatgtgaaattattagatcaagctaattaacatctttcatttttttcagtggtaatacatttgaaatttgctgtttcaatatatattattgactgtagtcaccctgttgtgcagtagatctcaaaatttattccttgagtttagctgcagccttctacccattctctttcccaccttccccagcaccccaccctcatcctctgataaccatcattctgttctctacttctaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351515 - DNA, 2729 bp, Homo sapiens
cttgagcaccagcagaaggttgggtgatggtcaaagttttagtcaagtaaaactgcaagacagaacttgatgtcacaaattcaatgaaggaattagggcggacatgcatattcttggtttgttccaatttccaatgggtcattaatgccgaattctgatggcaataggagtagatgaaatgaaaaagggctgggtgcagtggctcacgcctgtaatcccagcactttgggaggctgaggcgggcggatcacgaggtcaggagatcgagaccatcctggctaacacagggaaaccccgtctctactaaaaatacaaaaaattagccgggtgtggtggcgggcgcctgtagtcccagctactcgggaggctgaggcaggagaatggcgtgaacccaggagtcagagcttgcagtgagccgagatcccgccactgcactccagcctgggcaacagagcaagattccgtctcaagaaaaaaaaaaaaaaggagtagatgaaaaggaagcatgccctaaagatcatcaagtaaacctgtcttgaatacgtgtagcagtttttcactgttttggatttaaaaatgttttaagttttatttttaatcgacaagtcattgtattgcatttgtggaatacagtgtgatgctttgcaggtacataatgtgaaattattagatcaagctaattaacatctttcatttttttcagtggtaatacatttgaaatttgctgtttcaatatatattattgactgtagtcaccctgttgtgcagtagatctcaaaatttattccttgagtttagctgcagccttctacccattctctttcccaccttccccagcaccccaccctcatcctctgataaccatcattctgttctctacttctaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351516 - DNA, 1173 bp, Homo sapiens
atttctagcaacttttattcaatctttccaaggccctcgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtggtacgttgcagttcacctgggatttgatgaagagaagggccagcttgctctggctgactttaaacctcccgtgaaaagccgtgttggtgtacttgagtcattccaggtatatggcaagttttaataattcactggtctgccttgccttttttccccacagaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351517 - DNA, 1013 bp, Homo sapiens
atttctagcaacttttattcaatctttccaaggccctcgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtgaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351518 - DNA, 1524 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacattta

SEQ ID NO: 351519 - DNA, 1525 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggttgagcaggacattcttctttctgtactgtaatttgaaaataatttcaaacttagaaaagttctacaaatagtgcaaaaaacacccatgtatccttcacccagtgtcagcacttcacccctctgccttatcacttgcacatgcacagtcatcctcatggctttgcgtgcttacaaacgttacacacctggtttttctgtaccattggagattaagttgcatatgtcatgcttcttttagccctaaaaacgttgtggttatttccta

SEQ ID NO: 351520 - DNA, 1470 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacacttcggatttgaaagaagactgattaattcaacggagagagtggaggattagaaagattatggatgtgtgactggataaaatgcagaaaagttcctttgggagggatggtggtaaaatatgattgctctcgaagaagaagtggggggaagcgttggtaattaacggaatatgtcttgtaattgtgttttgtttccacaaaagtttggggggagagaggggggtgctggggggtag

SEQ ID NO: 351521 - DNA, 1490 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaaagtacctattggaaggttggttgagcctatttgaaaaacttaaggacagttagagggtcgagttttcatcacaatgacgcattgcaggttaaagaaggtccttccgatactacatggttcaacattgagagccgcgcaaggagcccatatatacagacgcccacacaggcgcgatagaggatagggaacccaacacaagagcccgggggcaaagagcccccgggtaaaaggacacagacgacgtcaaccgggtcgtggtaggaagcaccccccccgaggagggcgggctccccacacatgtgatgacacgcctgccggccaccgccgcaccaaaacgaacactattcaaccagcggaccagcgagcgggcaccaccgaacaacatgacagcgtcgcagggcggagcaacaaaacggcgagcaggaagacaccccggaaccgacgatatggtcgcacacaacgatctcttcccaaccacagagaaacagagcggctagcacggccatagatctcaccacg

SEQ ID NO: 351522 - DNA, 498 bp, Homo sapiens
agtacctcttaggacctaatctaaacctattacttcccaaaggtccacctctaagtagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351523 - DNA, 2430 bp, Homo sapiens
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaatagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattccacaggagtggagtggttgtctcctgtggaccattacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351524 - DNA, 1912 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttgggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcagacgagcctccactctttttcattggttctttaaatttgcctcggtagctttgcgatgcatggtttgcgagcaacctttcttgcagaatcgtcaacgtaagtttttctgaccgatgaaaaagaacctctaaaaatacaaggctctcttaaaatgtaatttggagccgtcttaacttacacatttcttgagaagttaaaggcacctccatagagaaacttgttcatctagtaagtaaataccagagtttcaaagcggctggattgttccaacaagggtatcattgcattaattattaaaatagagctttctatacaggagggtgttgtttagagtggttttttttttgaaagttctttattactaaaacaaagtggaaacttgagaccacgattctttgtaaaacattataaaggtacttttctccataaagggtagataatggattgggattttggtagcattttattttttctttctttctggtacattcttttagctgtcttgattcggagtcagctaggtaaaaggactcaattgcttcaccccactctctggtagtacagtatattgcagctggtttttaaaatgacttccaccaccctgatcctccagcaaaattggagaatggttatgaaggccatttcctgcctgttttagaggctacagaaactgtccgtatctgtagcgaagagagttacatgacattgttttcctttttacattacaggaataaagagacaataaaaataaataa

SEQ ID NO: 351525 - DNA, 523 bp, Homo sapiens
agctttgctggtagagtcgtaagtgaaatttggaccaaaagtgagtttatgaagactggtgggcaggagctcaacagctgcagggttgtcctgcagccagtgtctgatgtgccccagctgggaagctgatgaataggtgaggaaatgcacagggattccgtaactacttttctccttttagagaagtgccttggctctcttaccaaaagcactgcgattttttaaaacagttgaaaatgtgctttccaaatgaagccgtgcttgtttaccgtgaaggctgattataatccgtattgtaaggattgacctggtagggaagtacatcatgaactgaaactttacctaaaactttggatacgtgatccagtagtttcaagggaaatctacaaaagtcaggtttttaaaaattttttaaaaattctgaaatagagatgaggtctcaccgttttgctcaggctgggttgttgggtttgttttttatgtgtagtttttttttttttttttggagactcgctctgttgcc

SEQ ID NO: 351526 - DNA, 1151 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttgggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaa

SEQ ID NO: 351527 - DNA, 481 bp, Homo sapiens
taccccccgcccccaacaaaaaatggcaattttctatgtttcaacctaatagaaaaaaatggagttgtcaactgtgaaaatgcagaagaccgtgggaggagccaatttggaagagtggatgaacatgctgagcttgagagtctgcagtcctccaaacggtgccgtctcgtaggccagtggagatgagtctggttctcagagacctctgttctggggtgcttaaatccatgtgactgggttcgatcaccagggctgggagtgtagatagatgaaatcaagctcggatccttgaggcactctgacatttagaggggagaagagcagaaaactagctaaggagagtcagaagaaaagaaatgaatgtgaaagaaagccaagcatcacttgcacttaaatcattaccacggaagatatattagcttcaactttagtttaaaattatgtgaataaatattttgatttctacaaatcttaacattta

SEQ ID NO: 351528 - DNA, 3713 bp, Homo sapiens
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaatagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351529 - DNA, 3825 bp, Homo sapiens
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaatagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351530 - DNA, 2506 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351531 - DNA, 3602 bp, Homo sapiens
agtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctgtaatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctccaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaatagctgagatctgtatctgtggacctgaatgttgatccctcgcttcagattgacatacctgatgcgctcagtgagagagacaaagtcaaatttacagtgcacacaaagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351532 - DNA, 2181 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351533 - DNA, 2131 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351534 - DNA, 2175 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggagttcaacttaagattttacctaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351535 - DNA, 2041 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaa

SEQ ID NO: 351536 - DNA, 2687 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaaaacaacaaaaaaaaaaaacttcgaaacaagtccaagcacacctgaggtgatcggtgaaaatggtccgcaatacacgtgtgaacccggaagataccccgcgcgaaatctgccaattcaggaaggtttccaatcttgcgtgatacacattataagaaaaccgtcgtgaacatgcatcaaggccacacagaggttcatgcatataaccacaaggccagcacagatttcttgacacaaatgctcagcttgaccaggaagcccaggaggttgtatacccaattcccagacgcgtgttacaccatggcggtacgcagttacgcgacacggtggatgacgcaagcgcacacagacctaactgcagggaccggacaccacaaggagctagcgcgcgggaccgccacagacagaaagggtccacgtggacaaaatcagcgaccaaggacaccagcggcccttaaaaaacccgcccagcggagaatacagtgccagcaccatacaaagcgcggagtcagaacataggaagaacacaccccacggg

SEQ ID NO: 351537 - DNA, 2121 bp, Homo sapiens
  misc_feature (2064)..(2064): n is a, c, g, or t
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccacancggaagacggggggcgagggaggcgcgccgcacgcacccgggcgcccgcccccccac

SEQ ID NO: 351538 - DNA, 2494 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacattta

SEQ ID NO: 351539 - DNA, 2626 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggagttcaacttaagattttacctgtaagtgagatcatgtaatgtttgtctttctgtgcctggtttattttatttggcataatgtcctctaagatccatccacattgtcccatatgagagaattttgttattttaaaaggccggatagtataatgtatctatactacattgtcttcatccactgatggataattctcaattgattttgtattttggctattgtaaataatgctgcagtgaacatggaagtacggatatcccattgagatactgatttcagttccttttatattcccagaagtgggtttgctggatcatatggtaattctatttttagttttttgaggaacctctataccattttccatggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccagggtaagtgttttctacagatgaagccaacatcttttatggttttttccaagttatttcccagtttactaacccattgtcatcaggcagttggggtggccttgtggtattaatcgtctgtagtacttagttgatgggagccactcattgtttatttgtagtcttgtttataatgtcacccatgactaatttttagcaactttttttttttttttttaatagagatggggtttcaccattttggccaggctggacttgaacccctgacctcaggtgatccacctgccttggcctcccaaagtgctgggattacaggtgtgagctaaagctcccagc

SEQ ID NO: 351540 - DNA, 1054 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaagggtaaggatttctgtgttggtcttcataatatatattttataat

SEQ ID NO: 351541 - DNA, 869 bp, Homo sapiens
tgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggtaagtgacctttggctgttggagaaaattttttacttcatcgggaataggtgaccttttgtttctttgaaagagatact

SEQ ID NO: 351542 - DNA, 212 bp, Homo sapiens
ttttttttgagagatggtcttactctgccgcccaggctagagtgcagtgagtggcgcgtttcttcctcactgcagccccaaactcctgggctcaagcagtcctcctgtctcggcctcccaaagagttggcattacaggtgtgaaccatcacacctggccttatcgtggtatttctaaagcccaaatttctagcacctcttaaaaaactgggc

SEQ ID NO: 351543 - DNA, 577 bp, Homo sapiens
cactcatttaatcctccacagccccatgaggtcatatggtgatcccattttagagataggaagtctgaggcatggagttaagtaatttgccagccagtaagtggcaaagcaagaagcaaagtttctcagactaacttgagaaactttgctcttaactgccatgtttttctgcccactttctggctcaagttggcgaatatatttttcttattttggactttacacggtgtttatggtctgtcttttgccacccagaaatgcagaaaacctgtctgttctcttccttatagcttctgtgtttcatatcttccttaaaaagatcttcttagagaagcattcttctgtattttcacctactatttttactttcacaatgtttaaaatattttccatatttagatctgagtcttcccacctagaatatggtaatataaatatgtttttccattaatttttttagattttacagtttttcccatgttccatgttttccttgttccctcccatgcctagctggattgcagagttaagtttatgattatgaaataaaaactaaataacaattgtcctcgtttga

SEQ ID NO: 351544 - DNA, 4039 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatgaagtctgatgtcttctttgagcaccagtttaaaaggaaacatttcaaacagtaaaataaatcagtgtgtactttatt

SEQ ID NO: 351545 - DNA, 4266 bp, Homo sapiens
  misc_feature (4266)..(4266): n is a, c, g, or t
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaaaaaaaaaaaaaaaaaaaaaaaaaaaaaaaaaaaaaaaaaaaaaaaaaaaaaaaagagggggggccccgcccaaaaaaatcccccgccgggggccccaccaaccccccccccccgcgttcttggcacagaggggcccccaaaagaggggcccattataaaaccaagagcacacgggcccgcacgcttcaacacaacaagccgctcgaagagccggggaacaacacatcgcagacgcggagacatccatctctgggaggagagaaccccccatcctacgtgggggggggggagcaaccaatgttggcgccagacaaatattcccctcccaagcagaaataatttaagacagcccccagagacgggaccaattatataatcacatttcacgcaggtgtaataacgaggtggtgacaacaccacagccgggaatatgagcgctgcgacgcatgagaaacaaattgcgggctcacgcgtgatatgactatttgagaacacttttttacgcgagagacaatcgtaaatacn

SEQ ID NO: 351546 - DNA, 3985 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacatgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatgaagtctgatgtcttctttgagcaccagtttaaaaggaaacatttcaaacagtaaaataaatcagtgtgtactttatt

SEQ ID NO: 351547 - DNA, 3985 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaaggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatgaagtctgatgtcttctttgagcaccagtttaaaaggaaacatttcaaacagtaaaataaatcagtgtgtactttatt

SEQ ID NO: 351548 - DNA, 3985 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatgaagtctgatgtcttctttgagcaccagtttaaaaggaaacatttcaaacagtaaaataaatcagtgtgtactttatt

SEQ ID NO: 351549 - DNA, 1022 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggcgtactgacaaacggacagggggctgtttatttagacgagggtgcactatgccctatcaggctccctggccacctgcgtcgcctctctgctcctcctctcttactgttgcctacaatttttatcatctttttaccgttcaccttcctcttcctcccctttctacctctcgcctccctctctccttttcctatcctctcattcccactcataatgtacgtggtcctcattgtcacgcgggccctcgctagacgctggcgtgcgcggttagcggttcatgtgatccgtgacttcactttcgtgttgcctgtgtgcctcactaattcgtaatctcttattgttctctttgttcttgttttgttctttttagttctccgtctgttcttattttcagcgctcgggcccagtcactccgtcctctcttccgcctcttcttccctccacctagtttcccgtcagctttcaatcactatatgtttcctcctcactccccccgtcatctcttttatctctgaaggtccgcttctttctttcattatgctcgatatctctctatcacttcgccgtccctactccct

SEQ ID NO: 351550 - DNA, 730 bp, Homo sapiens
actataacttcaaaacatcagaaatagtgagtacatccatactaaggtagttagggtcacagttgtttaattttatgacatttgttttctagactctccaaccagaatcctcttttttcctttacctcattattgtcttttcctcaagatcccgtattcttttccaccaaccaagctaatgcatgttgttagccctctacatctttctttaaaaactaagttcaaaatagacaacagagacaactaatgaggcaaagaaatatggattttaggctatgaatatattgatattaagctactaataaaagggtttatttttaatgattgtgaacatgtttaaagtcaatcctataataaagcataattaaattctaatttttattttcttttgtattttagtcccatacaaaaggaaatatttatcaggtaagtaatgatttggtctttaaatttttcccacaattaaaaatatatcaaaattctggcatattaaaatacattacagatccctttttaaaattatgtaatataaagtagaacaatttttataagaatgtagaaaggtctcttagtaataagactcaacattttaaatatattctacaatatgtagttttgtctggcttcttttactcgggaatatttttttagattcatctgtgttgtgcacattcactgaattttttccctaagtgtcataatactttataaatatatcatatattgtcca

SEQ ID NO: 351551 - DNA, 993 bp, Homo sapiens
cggccgcgcagccgctgccgcccacccgcacccgccgtcatgctccgggccgcgctgcccgcgctcctgctgccgttgctgggcctcgccgctgctgccgtcgcgggtaagcccttacgtagtccctcgccgggaccgtgcgcgaccgccttcgcccccttcccaacgcacgctcttcgtccccgcgcacccgagggcggccgcagacgcaacacccggccggacatcccgcccttccctgcacgcccgtcccccgtgggtcctggctccgggtcacctctcacccgcctgccctcggggaggggaggtggccgagaataagggagggctctgtcttcctcggagtccacatcctcaccgcagaccccactccgcggggagggaacccccaaattaggccagttggccggagaactgagggacttggagtcgcacgacgggcgccgtttcagggcaatttcgggctgaaatgagaagcggggacgttggtggcgatttcccctgctggtgcgcggccggagtggggttgctgggatgggggtgggggccggaggaagtaggccctcttttgcaagcagcgctgtttgtctagttggttggtgttcaagttgtttaaacaggaaaacagttcagcgcaaataacccctggatggaagaggaacgggaataggcaaagcttggatttcactgaaatcaaggagttttaaagttctagtctgctgttgtgcaagtgacatctgaaaaatcacacacgtgatcattcatttacaaaacgactcgtgaggaaaatgcacaattctattgaccgtggtctttatttttaaaaaatttccatacaagcatgtcaaaaatatgtggatggggagactctggagaacacagacttccaaaaacaccactgactgaataattccaggaattaaagagcaaaataaacaagaactaaatgagtacttgtgtgggcttaaataaagtgcaagagatttaaataaa

SEQ ID NO: 351552 - DNA, 3986 bp, Homo sapiens
cggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttctgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatgggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttgtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatatgacggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatgaagtctgatgtcttctttgagcaccagtttaaaaggaaacatttcaaacagtaaaataaatcagtgtgtactttatt

SEQ ID NO: 351553 - DNA, 229 bp, Homo sapiens
gcggccgcctactactactactgctcgaattcaagcttctaacgatgtacggggacatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaat

SEQ ID NO: 351554 - DNA, 244 bp, Homo sapiens
ccacctcggcctcccaaagtgttgggattataggcgtgacccagttctaggtcccaattctactgcaaatagtatcatggcatcttatcagcaacagaagacttcggttcctgttcttggttagtattttttctcatttaatattacaatactaagcagaaggactatctttctgtaagtattgagaagatcagcagtataaggagagattggatacaatttttcactacaaaaaattgactac

SEQ ID NO: 351555 - DNA, 6040 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351556 - DNA, 3478 bp, Homo sapiens
aggtggatcttagaggtccctccctatgagacatcacatcgagccctggtatagctcagatacggaagtggttggaccaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351557 - DNA, 6129 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagatagatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351558 - DNA, 2715 bp, Homo sapiens
atgaatacttcagagcttcgttatacaagtttttatcttttatcaagtttaagcattctgggaaggtaccgatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351559 - DNA, 2472 bp, Homo sapiens
gatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351560 - DNA, 2483 bp, Homo sapiens
ttactgttaagggacgaagtggtttagtgagagataccaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351561 - DNA, 2318 bp, Homo sapiens
actggcgcctttactgacgcgatattattgaaaccaacgtagaggccattccatttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351562 - DNA, 2419 bp, Homo sapiens
gatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351563 - DNA, 5162 bp, Homo sapiens
  misc_feature (4496)..(4496): n is a, c, g, or t
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtcttgaactcctggcctcangtgatcctcctgccttggcctcccaaagtgctgagattacaggtgttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaat

SEQ ID NO: 351564 - DNA, 6129 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaatgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351565 - DNA, 2421 bp, Homo sapiens
gatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgtacgtatcacattgattcgacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351566 - DNA, 2431 bp, Homo sapiens
gatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351567 - DNA, 2978 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaagtaagtattttgaataattcatgtgtatctttt

SEQ ID NO: 351568 - DNA, 568 bp, Homo sapiens
ctactggagcatagaatatttgctgaagttgtataatggaaggagaaatagattttgatttttaggacattatacctggaatggtttagataacttattatttttaaagtcatccaaatgcaatgtaaatatgtaaggttttgtgggcaaatggagcctctgtgtaaaacaggaaaaggcactctttcctctgggcaagtacagtcccacagtgggatgaaccgctcgccgagagacaagggacacatgggatttaaaacttccttggataaagatattcattaattcgttcattcattcattcatgtttgctggaaaaaaaactcttctggattttatctattctttagttaggtgagctttcgatattgtaacactctgagtttgctttaagaccctcaggcagtttgattgcatctacacaagataaacccaaccagcaggatattgtgttttttgagaaaaatggactccttcatggacactttacacttcccttccttaaagatgaggttaaggtaagtgcctgagtttgtttcaccctcgaatgtagaggactttccatagc

SEQ ID NO: 351569 - DNA, 6185 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351570 - DNA, 5449 bp, Homo sapiens
  misc_feature (5449)..(5449): n is a, c, g, or t
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaataaaaaaacaaaaaaaaaaaaaaaaaaaaaaaaaaaaaaaaaaacaaaaaaaaaaaaaaacaaaaagaaacaaagacaaaagacaagatacgaagaaaacaacaagacaaaccaaaccaagaacaagggagggcgcagacaacatatcaacaacagaggggggcaaaccgcagcagccagacaccgccgattgaggaggagcgggtatcgtagtgacgacgcaaccaaggcgagggggcggcagcaaaagagacggaggaagacgaccagcgggagaggcgtggagaccactgggggggtgcataaacaagcccaccagagcaacaggtgcgaaaatacataaggaggtgggcaacaccgtctgccgggagctgccacagaaaaaataagn

SEQ ID NO: 351571 - DNA, 1215 bp, Homo sapiens
atgaatacttcagagcttcgttatacaagtttttatcttttatcaagtttaagcattctgggaaggtaccgatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagtgggagatgaaggtatacccatattttacacaggtactccttctctttcgagagttcgatggaaccagggaagggcaattcacagacagggccttttggcagaaatactgcctggcaagttcggttgggcaagggtcccatttccagaaacactttcgggagctctcttaagttacccacggcagaaatttcaggtaacacccggggatacaaggggtcccaattctatacgggcactatgtatcgacggcgagtcgtagcttagcgacagaaaggacgttcggtccaggatcatctagaggtgaagcttgttataccagcccaaggattctaacagaaagacccagtgagtctgagcctggtcaatagtgagagtgcagttgaggggacctcacgcacagac

SEQ ID NO: 351572 - DNA, 6302 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccagagatggggtgttactagttgcccacgctggtctgaaactcctggcctcaagtgatccctccacctctgcctcccaaagtgctgggattccatgtgtaagccactgtgcctgaccaaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351573 - DNA, 6144 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgtcagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataaaaaaaa

SEQ ID NO: 351574 - DNA, 5059 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaat

SEQ ID NO: 351575 - DNA, 376 bp, Homo sapiens
ttgtaaagtgagtattttaaagtatttcaataaaatttaaggggataagtattccagcattcaacacagccttattaggaaaacaaagtcagtctgctatcttctgtgtagaacacatgaaatgaagattcttcacaatctcaacttagctttttccagttacgtaacacttaaaaaataactttgggtgagtttagatatttttaaaaatctggagttattcataagaatcaaggaatttaaaaattagtgatcaaatgtggctactttagccatacataggccaagtctatccttgtttaataacttcaagatgagcctttaatttcacattcattaataagtagaatcttgtccaacatccttatcactaaat

SEQ ID NO: 351576 - DNA, 3089 bp, Homo sapiens
  misc_feature (1277)..(1277): n is a, c, g, or t
  misc_feature (2941)..(2941): n is a, c, g, or t
atcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctcttcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgagatagtcatttttacttgaaggaagctgcttctacttgggagtggcaggagaagtgagaaaaccacatggaagactcccaggatttaaatgaacaatcagtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggaggggaaaacatgactgttttaaacatagcagactggttgctgagttgcaacaccccctcttctgcaacaatgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaagccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttngccaaaaccagtatgcacagtattattcagcatcaacgtatggagcgtatatgacatcgaataacacagccgatggcacaccctcttcaacctctacttatcagttgcaggaatctctcccaggactgactaaccaaccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatctattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggngaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaa

SEQ ID NO: 351577 - DNA, 823 bp, Homo sapiens
atcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctcttcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtaaatgcaagaacactggacattctgtaaaaacaggcccctctttataaggagtttattcaccatagttctgtattgcagctgctgatcatatttcatggagctgttaaagcacttaaaacctaaaattagataaggaagctgagacccagtcatgcagcacagtggagccaggatcctaactccccagtatgaggccagcacccttatccttaagcgtgtgctgggctcttgcttccatcagtcatataccaccatttttaggtggtacctgaacattttgttttaataatacttatattttatgtaaggataactagatattagaaaaatttgttaaattttgtattaaacctgtaacttcatgggcaatattgtttgagacaagaccaaacaaagtattgaagtcaaagaaaaaaaattaagtatctgaagaaacg

SEQ ID NO: 351578 - DNA, 2436 bp, Homo sapiens
  misc_feature (606)..(606): n is a, c, g, or t
  misc_feature (2288)..(2288): n is a, c, g, or t
ggagtttaaatcatttgtctatggtcactagattggcttgtagcagagcctgagctcctgacattcagactgttgctttttcctatattgttaaaattatattgtggataaagaggattacttcctggatattatagggtttcactgaatctaggctgtctaaattaatacacagtctttgttgccacagtaatgctatttttctgatatttaggccctatccacacattctttctacaccagcagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttngccaaaaccagtatgcacagtattattcagcatcaacgtatggagcgtatatgacatcgaataacacagccgatggcacaccctcttcaacctctacttatcagttgcaggaatctctcccaggactgactaaccaaccaggtacagatcttcacccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatctattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggngaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaa

SEQ ID NO: 351579 - DNA, 469 bp, Homo sapiens
catagcattaagtcactcatggtgagtgtgaatttgctcatgagcatattaattagctagtgtgtgctccattttcctcatctgtgtattaactggagtgctatttcagatatgagcaagaattgtagacctggaagagacacaggtgtaaaatctaaatcaaatttctacttttacaggtgtggtatagacatagggagtttaaatcatttgtctatggtcactagattggcttgtagcagagcctgagctcctgacattcagactgttgctttttcctatattgttaaaattatattgtggataaagaggattacttcctggatattatagggtttcactgaatctaggctgtctaaattaatacacagtctttgttgccacagtaatgctatttttctgatatttaggccctatccacacattctttctacaccagcagctcaaacaatgtctgcctatgcaggcc

SEQ ID NO: 351580 - DNA, 1958 bp, Homo sapiens
  misc_feature (1)..(1): n is a, c, g, or t
  misc_feature (5)..(8): n is a, c, g, or t
  misc_feature (21)..(21): n is a, c, g, or t
  misc_feature (128)..(128): n is a, c, g, or t
  misc_feature (1810)..(1810): n is a, c, g, or t
ngcannnngttttttacctcnaggttctagttttgcaccatcatctactatttatgcaaataattcagtttccaattcaacgaatttcagtggttcacaacaggattatccatcctatacagcctttngccaaaaccagtatgcacagtattattcagcatcaacgtatggagcgtatatgacatcgaataacacagccgatggcacaccctcttcaacctctacttatcagttgcaggaatctctcccaggactgactaaccaaccaggtacagatcttcacccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatctattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggngaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaa

SEQ ID NO: 351581 - DNA, 2732 bp, Homo sapiens
  misc_feature (902)..(902): n is a, c, g, or t
  misc_feature (2584)..(2584): n is a, c, g, or t
gtaatcttctaaagccagctggcacatttataggatgccaggctagcccatcagatgaagtgtccattgtggcagccacagatccacatcagatgggaagagtgtgatcagtgctgcatgcatgtttaatcaggtaacaatgggagctgtacaggaagaggattattattccaagaagaaaggacctatatcatcttgtggaaggtaaagaaaacgtgcacagaatcagatgtttcacaatctcagaattccaggtctatggaaatgcaggacctagcaagtcctcatactcttgttggaggtggtgatactccaggtagctccaaactggaaaaatctaatctcagcagcacatcagttactacaaatgggacaggagtgtctcttcttgcagtcaaaacagagcccttgaacagcagtgaaaccacagccacgactggagatggagcgcttgacacttttactgggtcagtaattacaagtagtggctacagccccagatcagcacatcagtattccccacagctgtatccttccaacagctcaaacaatgtctgcctatgcaggccagactcagtattcggggatgcagcagccagccgtctacacagcctactcacagacaggacagccctacagcttgcccacttacgatttgggtgtgatgttgccagccatcaagacagagagtggactttcccaaactcagtccccattacagagtggctgcctcagttacagcccagggttctctaccccacagccaggccagacaccttattcttaccaaatgccaggttctagttttgcaccatcatctactatttatgcaaataattcagtttccaattcaacgaatttcagtggttcacaacaggattatccatcctatacagcctttngccaaaaccagtatgcacagtattattcagcatcaacgtatggagcgtatatgacatcgaataacacagccgatggcacaccctcttcaacctctacttatcagttgcaggaatctctcccaggactgactaaccaaccaggtacagatcttcacccaggagagttcgataccatgcagagtccctccacacccatcaaagatcttgatgagagaacctgtaggagttctgggtcaaagtccagaggaagaggccggaaaaataatccctccccgcctcctgatagtgacctggagcgtgtgtttgtctgggatttggatgaaaccatcattgtttttcactcactgctcaccgggtcttatgcacagaagtatggcaaggatccccccatggctgtaacccttggactccgcatggaagaaatgatttttaatcttgctgatactcatttgttttttaatgatttagaggagtgtgatcaagttcatatagatgatgtttcctctgatgataatgggcaggacttaagtacctacagttttgcaactgatggcttccatgcagctgcaagtagtgcaaacctttgtttgccaacaggtgtaagaggaggggttgactggatgaggaagttggcttttcgttacagaagagtaaaagaattatataacacctacaagaacaacgttggaggactccttggccctgccaagagggatgcctggctacagttaagggcagagattgaaggtctgacagattcctggctaacaaatgcacttaagtctttatcaattattagcactaggagtaactgcataaatgtcttggtaacgacaactcaactgatcccagcacttgcgaaggttctactctatagtttaggaggtgctttccccattgagaatatttacagtgcaactaaaataggaaaagaaagttgctttgaacgaataatgcaaaggtttggcagaaaagtagtgtatgttgtaattggggatggtgtagaagaagaacaggcagcaaaaaagcacaacatgcccttctggaggatatccagtcactcagacctcctggctctccaccaagcactggaattagagtatttgtaactgtgttctttagccggagatctattttttatatttcaagtacactgaatttttatgtgtgattcaatgcctctggctctacacatataaattgtcttaatggatgaaatcatatttggaataaaaattccagaatgaagaattcagattgctgaatggagttaaactttagtgctacagaaaagaaactctatggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggngaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaa

SEQ ID NO: 351582 - DNA, 1050 bp, Homo sapiens
tcaagtctcgtatacaaaatgagaatttgtaatcaactgctgaagcatttatatggtcctatttagaacatcctgggatgctcctactatgtgggatcttttggagaaaaaaatccatacctgagcaagtggagagaagggaccagattcagaggatacccataaaatgatctgcaagggaaaacaagtttctgaccaagcacggttacaaccacatcttcctgggacaaatgaggacatgtatcaattcctcaccaaccttccatacaccccaggcttacctaggaactgccttcagcacaccatgtctaccagagtggcggtatataatcactattcaactccacagccagagagaggtgcagaagccatcacaggaaatgactagatgcccctgagctctctgttgctgctgccgtgcgggtgactgggaatcacatagttaactaaaagcttttactcagcttaatttcctccactctacatgataattgctctgttcattttcgctttacctttaaattcagggcacatgcacaaagacataatggtgtaagagtggaaaagagaagatgtattttctaagctgcctgcagtctgacaattgtttgaatgtgtgtgtacatttaacaagatggtagattacagcattaccttatcttcagggtaaaactgccattcaggatccaaaaatctcctaatggtttattgaaatggttccctcttgcaatgcatcatcacagtagtttatgataaggagaaaagtatgttctgatacaaatcaaataatgccaaatacaaagagttgtaagagaaatagctcacttgggagatagagagaattgaagaaaatgtattgggtgagagacgctaactagacctctggaaagagaagtcagcaatgacccaaatgggatacttgattctcttcagtggtcaaaaaccctcaggagaaggataaataggtatttattatttggtataggacatgatattttgaaatacctatatattatgtaatggttaaattgagctaataaaataaacatg

SEQ ID NO: 351583 - DNA, 1033 bp, Homo sapiens
accttgccccttcctcgtgatactttcttgttcttcctctctttaagggttggggggggggtggatactattctacatcttctagaaagaagactccttccctcatacccatgaatatcaaaggaccaaatacagaggtatcctgtcttctgatcggactgggaaatcactataccaacctatcatgtaatcaaactcatctccttgggagggggggcgacatgtatcaattcctcaccaaccttccatacaccccaggcttacctaggaactgccttcagcacaccatgtctaccagagtggcggtatataatcactattcaactccacagccagagagaggtgcagaagccatcacaggaaatgactagatgcccctgagctctctgttgctgctgccgtgcgggtgactgggaatcacatagttaactaaaagcttttactcagcttaatttcctccactctacatgataattgctctgttcattttcgctttacctttaaattcagggcacatgcacaaagacataatggtgtaagagtggaaaagagaagatgtattttctaagctgcctgcagtctgacaattgtttgaatgtgtgtgtacatttaacaagatggtagattacagcattaccttatcttcagggtaaaactgccattcaggatccaaaaatctcctaatggtttattgaaatggttccctcttgcaatgcatcatcacagtagtttatgataaggagaaaagtatgttctgatacaaatcaaataatgccaaatacaaagagttgtaagagaaatagctcacttgggagatagagagaattgaagaaaatgtattgggtgagagacgctaactagacctctggaaagagaagtcagcaatgacccaaatgggatacttgattctcttcagtggtcaaaaaccctcaggagaaggataaataggtatttattatttggtataggacatgatattttgaaatacctatatattatgtaatggttaaattgagctaataaaataaacatg

SEQ ID NO: 351584 - DNA, 1105 bp, Homo sapiens
aatcatgagttatttgttaaaggtagggggggggaacctagctgcagacgactctcttattctccaccgctacagcagaatttgtaatcaactgctgaagcatttatatggtcctatttagaacatcctgggatgctcctactatgtgggatcttttggagaaaaaaatccatacctgagcaagtggagagaagggaccagattcagaggatacccataaaatgatctgcaagggaaaacaagtttctgaccaagcacggttacaaccacatcttcctgggacaaatgaggacatgtatcaattcctcaccaaccttccatacaccccaggcttacctaggaactgccttcagcacaccatgtctaccagagtggcggtatataatcactattcaactccacagccagagagaggtgcagaagccatcacaggaaatgactagatgcccctgagctctctgttgctgctgccgtgcgggtgactgggaatcacatagttaactaaaagcttttactcagcttaatttcctccactctacatgataattgctctgttcattttcgctttacctttaaattcagggcacatgcacaaagacataatggtgtaagagtggaaaagagaagatgtattttctaagctgcctgcagtctgacaattgtttgaatgtgtgtgtacatttaacaagatggtagattacagcattaccttatcttcagggtaaaactgccattcaggatccaaaaatctcctaatggtttattgaaatggttccctcttgcaatgcatcatcacagtagtttatgataaggagaaaagtatgttctgatacaaatcaaataatgccaaatacaaagagttgtaagagaaatagctcacttgggagatagagagaattgaagaaaatgtattgggtgagagacgctaactagacctctggaaagagaagtcagcaatgacccaaatgggatacttgattctcttcagtggtcaaaaaccctcaggagaaggataaataggtatttattatttggtataggacatgatattttgaaatacctatatattatgtaatggttaaattgagctaataaaataaacatg

SEQ ID NO: 351585 - DNA, 345 bp, Homo sapiens
aacagctctttagtttgcagagggcggttcaggaacaaatatgtatgtgtttattacgtaccaggcactgaaatgggcccttgaacagaacaaatcctttcccctgagcagcaccctgagagcagggctggagctaattatgtgtgtggctgctattgtatgcggagaaaactagatgggcccatagtctagaaaagtaattataaaaactgagtaagtgccatgcccatcatagtaggggcttttataaatattccctttttcagcttggggcctctcaatttccccaggtcctcagaattacacacccccacaagggttcctgggctgcccccaggagttagg

SEQ ID NO: 351586 - DNA, 578 bp, Homo sapiens
gctgagaccacaggggttccctcaaatcatgtcacacatcagtgatccaccccatctatttgaccatgtccctgaatctctcagtgcttctgactccagacagcgcgaggaaaggctgaggcaggaggcctaggtggagaccctgcctgagagatgagtcactcggctctggcaggacaggcttcagggggatcagctcagcttagctggggaacgctttctgctctcgtaagcccctcatccccataccacactcaactcttcccttttgtcaccttcaaaaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351587 - DNA, 541 bp, Homo sapiens
agagcaggcatgttgccccaaatacctgtgttttccttgtttgcagcagagtgtatgtcacatagtagaagttaaagccaaagaaacgattgaattaatgaatgtctctgtgggttattcttaggagtaatttaaacttatgaagtttaagttttggaaaattttagaacaagaaagctttaggataatatatttgtcttttctaccactgtttactaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaaggtactaagagatcatttgatgcttttttcagttgatttagacctaatgtcatctttgttcatttataatcattcagtcagtctgtccctgtcccctctacatatgtatcatctataccctgtggaaagta

SEQ ID NO: 351588 - DNA, 422 bp, Homo sapiens
attccaagggacgggggattctttcaaagagcatctcgcctgcttataaaggaggctggctctgaagccgtcatctggagtctgtagtgaaggcctcttgttagggaaactggatggttagtgttcaaaatccattttgcgtgtgtgcaaggacacaggtggtattaaacagaagagaaaatcagatgactgtgaaatgttcaatactaaataagatgatttttagtttttccaggggcattgttatttgtgaccacaatgaaaaatgtagacagtgatgatctggtaactggcacacttcccaagctcaagagctcaaaagaatggttggagcccaagcccctttgttttatggaggtatatatcaaatagtgtgggatttggagattttttacttggatcgttgcagtaggaagtggctt

SEQ ID NO: 351589 - DNA, 786 bp, Homo sapiens
aggcgagatgttccggtcggggaggccctgagcagaggaacccgggtggagagggcggggcctgaggagggcggagagctggggcgggtctcagagctgctccaagcttttctgccatttgaagcttcttctgggagccagctgtgaccagaggaatagctccagccatccggttaaaagtttaacaaccggaacagctccagtctgcagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagccgtgacagactacctggaaaaatgggacactcctgcccaaatactgcacttttcccaagatcttagccaccggcagacaaggagattctctcccatgcctggctcggcgggttccacacccacggagccttgctcactgctagtgcagcagtctgagatcgaactgtgaggcggcagcctggctgggggaggggcgtccgctgttgctgaggcttgagtaggtaaacaaagcagccgggaagttcgaactgggcagagcccactggcagctcaagtaaggcctactgcctctagactccatctctgtggccagggcatagctgaacaaaaggcagcagacaacttttgcagacttaaaggtccctgtctgacagctctgaagagagca

SEQ ID NO: 351590 - DNA, 865 bp, Homo sapiens
tcttgctgtgtcacccaggctgaagtgcagtggcacaatcttggctcactgcaacctcctcctcctgggttcaagcgattctcctgccttagcctcccaagtagcttgggactacaggggcccaccacctagcctggctaattttttttgtatttttaatagagacgggtttcaccatattggccaggctggtcttgaactcctgaccttgtgatctgcccacctcagactcccaaagtgctgggattacagttaaaagtttaacaaccggaacagctccagtctgcagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagccgtgacagactacctggaaaaatgggacactcctgcccaaatactgcacttttcccaagatcttagccaccggcagacaaggagattctctcccatgcctggctcggcgggttccacacccacggagccttgctcactgctagtgcagcagtctgagatcgaactgtgaggcggcagcctggctgggggaggggcgtccgctgttgctgaggcttgagtaggtaaacaaagcagccgggaagttcgaactgggcagagcccactggcagctcaagtaaggcctactgcctctagactccatctctgtggccagggcatagctgaacaaaaggcagcagacaacttttgcagacttaaaggtccctgtctgacagctctgaagagagca

SEQ ID NO: 351591 - DNA, 257 bp, Homo sapiens
cccttgcctcctttttttaatcttcttatgtgagcaaactttttctataattttcttctgaagagggaagattaaaaaaaggaggcaaggggaattagatggctttttaaaacatgtaaataaaaaggtactaagagatcatttgatgcttttttcagttgatttagacctaatgtcatctttgttcatttataatcattcagtcagtctgtccctgtcccctctacatatgtatcatctataccctgtggaaagta

SEQ ID NO: 351592 - DNA, 456 bp, Homo sapiens
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcggcgctgcgtccgggagacggtgggcgccaacattcgcgcgttccgcagacgcgggcgggctcccttccagccgcagtcggacggctccggggtcgtcgggccgggcccgagtgtgtagcaggacggccgcgggcctgctggccttgggagggcagagaggtgcctgtcgcggccggcgacctcccc

SEQ ID NO: 351593 - DNA, 467 bp, Homo sapiens
agagcaggcatgttgccccaaatacctgtgttttccttgtttgcagcagagtgtatgtcacatagtagaagttaaagccaaagaaacgattgaattaatgaatgtctctgtgggttattcttaggagtaatttaaacttatgaagtttaagttttggaaaattttagaacaagaaagctttaggataatatatttgtcttttctaccactgtttactaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggcttttcgccacatgtatatcagtcggcgactatagagatcacgacgatcctgttccacagctgacatagacgcaatgtgat

SEQ ID NO: 351594 - DNA, 907 bp, Homo sapiens
aaaacagaagagccaacaccacaccttcctcatcccctcgcgccgaccgcctcgcctttcccctagttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351595 - DNA, 1249 bp, Homo sapiens
tgaggagggtggcgagaggtggggtggggcccaggtgagtagcgggcgaaggcggggcctgaggaggactgagctggggcgggacccagagctgctccaagcttttctgccatttgaagcttcttctgggagccagctgtgaccagaggaatagctccagccatccggttaaaagtttaacaaccggaacagctccagtctgcagctcccagcgtgatcgacgcagaagacaggtgatttctgcatttccgactgaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351596 - DNA, 1744 bp, Homo sapiens
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcggcgctgcgtccgggagacggtgggcgccaacattcgcgcgttccgcagacgcgggcgggctcccttccagccgcagtcggacggctccggggtcgtcgggccgggcccgagtgtgtagcaggacggccgcgggcctgctggccttgggagggcagagagtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351597 - DNA, 1599 bp, Homo sapiens
  misc_feature (355)..(355): n is a, c, g, or t
  misc_feature (370)..(370): n is a, c, g, or t
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcgggcagcatgccggtcccccgggaagaacgggtgggggccggccccccaaacccaattttcgccgggcggttttcccccggcaaangaaaccggccggggnccggggctcccttccagccgcagtcggacggctccggggtcgtcgggccgggcccgagtgtgtagcaggacggccgcgggcctgctggccttgggagggcagagagtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351598 - DNA, 1133 bp, Homo sapiens
cgatgatatgatttggaggaaacaaactgcatgcatagagaactttccagggatatgtctgtcatgctaaatataatgattccagatagcactaatagtttttaaagattttcttttcaaagtttaattctgtcctttcaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351599 - DNA, 915 bp, Homo sapiens
attccaagggacgggggattctttcaaagagcatctcgcctgcttataaaggaggctggctctgaagccgtcatctggagtctgtagtgaaggcctcttgttagggaaactggatggttagtgttcaaaatccattttgcgtgtgtgcaaggacacaggtggtattaaacagaagagaaaatcagatgactgtgaaatgttcaatactaaataagatgatttttagtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351600 - DNA, 1493 bp, Homo sapiens
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcggcgctgcgtccgggagacggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcctctctgtgcagatgtgatcatccctccaactcctagtaccagcccctgtctgctctgaggctctgctgtcagtcccctacgtgatctccaaggatcctcaggtcccagatgggagccctccacggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351601 - DNA, 832 bp, Homo sapiens
  misc_feature (45)..(45): n is a, c, g, or t
ggagtgagcgaattaatagaatgtgaacaagttgggcacaatggngagcggcctccaggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcctctctgtgcagatgtgatcatccctccaactcctagtaccagcccctgtctgctctgaggctctgctgtcagtcccctacgtgatctccaaggatcctcaggtcccagatgggagccctccacggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351602 - DNA, 1473 bp, Homo sapiens
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcggcgctgcgtccgggagacggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtctccctccccgcgtttgggactgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351603 - DNA, 1416 bp, Homo sapiens
caccccgctctgtggtgcccgcaaggacccggcgaccaaggacccgaccgtcaacggacgcggttgcgggtgggtggcggcggcaggattggccgggccacgcgccggtcaccgagaagcagcgactccagccccttccgcaaaccaagacccgccacctagagccgccgcccaatcccctttgggcctgaagccgtcctccgccgccccggcaccgcccgcgcggactcgctgtggaacccgcggcgcagggggcggagtgctcgcgcggcgctgcgtccgggagacggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacccttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctcaaaaaaaaaaaa

SEQ ID NO: 351604 - DNA, 2496 bp, Homo sapiens
cgccgcgaccccacaggcagggagccgcatttaggtttcgggcgggcggacgggggacggcccgagtgaggcgtcctccgaaggctgcgggcccgaagccagaactccttcctctccgaagacctcgggggtggggctcgcgcttccgcagcgggcctagagcgagaggcaggcggcaggtcaagagactgctctcctccccaagctaggggaaccttctgggactccatcaactgacaatgaggggataatggtccctcactgccccatcaggaaaggctcatgggtgattgggacctttgcttgaaacccaacttactggccaggaacctcaagttctgggaccaggcgccttcctccctcccactgtgccagaggaggggagacaaaatccctcaatggctgtctagctccaggcagatcagctgccacggggactgctgagcagggagaggctgtcgatgctgaggcacgagagaatttgctcctgctcctccagagaaaatggctgggacaggctgttgaggaataattctgcagggaaaagtggaagatggctgtgaaagactgggaggaggctggctgtgttttcaggggttcttcctgcacagtcggtagaagctgagctgctggggaaggggctggaagaaagcccacaccgcaggtatcagtagcaaattcaaaaactacagaatcagctccagaggactttgttaacaagaaagagaagattgaaaacagccctggggctacaccaactcaagagctcccaggcaaagtggcatcctggacccaccatctctcctaccccatcctcagtcggtacttccccaggcaccgtttgttctggcatggggctagttcagccctgggaccaccctcatccttataactaccagctgtctttggtgaggtgcaagatctctctggttttctttatttcattttcattcctataatcacagccttttttgtgcccatccctcaggtgacattctattatgtttgatgtgtcattttgatttggttgtgtccttgcaaaatgtgcgttgttttatttatcaatttattttatttttatttttttaaagagatgaggtctcatcatgttgcccaggctggactccaactcctgggctcaagcgatccttccacctcaatcttctgagtggctgggactacagatgtgcgccaccatacctggctattgatcaatttttagtttaccaaacaggcattatgttctgggtcccattctgtgtcgggttctcttttcactcggcaccatggctttaggatccatccatgctgctctgtgaacgccgagttgctttaactgcttggtgctccatgaggcatccccttttgtgtctctgtcctcccagtgagggaccccatcgtaccctactcccctcccacaaaggaagctgtagtgcgcgtcctcaggcgtgtccccatatggatctgctggcattcgtttgtcagtgcacccaggggtagaagtccttggtctcagtctgcagacgtctgcctgagtgcagccaggtgcccccccagagtgggtagccttgtccacatgcccatcagcagcacctgaggggtcccaacagccctacatcccaccaactttctgcttttttccagtcaaatggctcttgagtgttacctggctttatttatttatttattttttgagtcgggtctctgttgcgcaggctggagtgcagtggtgcaatcatggctcactgcagcctcgaccttccaggctcaaacaatcctctcacctcctgagtagctaggactacacgcatgtgccaccatgcctggctaatttttaaatttttttgcagagaaagggtcttgctatgttgcccaggctgatcttgaactcctggcctcaagcgatcctcctgccccagcctcccaaagtgctgggattacaggtgtgagccactgctcccggcctgtctttattttgtattcttggattcctagtgagtttgagccccctctatacatcataacccttatgatactagtaaacatatattttatctttaaccccatttctggcacagaactcctaaaagccttactctccaaaatgatctctttctgtgtactaatggattgactgaaggctggcagcccctaggtagcttcaagatgggggctggtcatcagagagacataggcaggattagagggttgggactttcatcccaccatcccacgtactgggagggaagggggctaaaggttaagctgttcgccaatggccagtgatttattcaatcatgcctacgtaatgaagcctacacaaaaacccaagaagaccgggttcagagaacttctggtagctgggcacatggaggttcctggagggtgccaagccctggaagctctgtgctccctcccacatgccttgccctatgcatctcttcatttgtatcctttgtaatatcctttctaataaactggtaaatgtaaaaaaaa

SEQ ID NO: 351605 - DNA, 2227 bp, Homo sapiens
cgccgcgaccccacaggcagggagccgcatttaggtttcgggcgggcggacgggggacggcccgagtgaggcgtcctccgaaggctgcgggcccgaagccagaactccttcctctccgaagacctcgggggtggggctcgcgcttccgcagcgggcctagagcgagaggcaggcggcagggagaggctgtcgatgctgaggcacgagagaatttgctcctgctcctccagagaaaatggctgggacaggctgttgaggaataattctgcagggaaaagtggaagatggctgtgaaagactgggaggaggctggctgtgttttcaggggttcttcctgcacagtcggtagaagctgagctgctggggaaggggctggaagaaagcccacaccgcaggtatcagtagcaaattcaaaaactacagaatcagctccagaggactttgttaacaagaaagagaagattgaaaacagccctggggctacaccaactcaagagctcccaggcaaagtggcatcctggacccaccatctctcctaccccatcctcagtcggtacttccccaggcaccgtttgttctggcatggggctagttcagccctgggaccaccctcatccttataactaccagctgtctttggtgaggtgcaagatctctctggttttctttatttcattttcattcctataatcacagccttttttgtgcccatccctcaggtgacattctattatgtttgatgtgtcattttgatttggttgtgtccttgcaaaatgtgcgttgttttatttatcaatttattttatttttatttttttaaagagatgaggtctcatcatgttgcccaggctggactccaactcctgggctcaagcgatccttccacctcaatcttctgagtggctgggactacagatgtgcgccaccatacctggctattgatcaatttttagtttaccaaacaggcattatgttctgggtcccattctgtgtcgggttctcttttcactcggcaccatggctttaggatccatccatgctgctctgtgaacgccgagttgctttaactgcttggtgctccatgaggcatccccttttgtgtctctgtcctcccagtgagggaccccatcgtaccctactcccctcccacaaaggaagctgtagtgcgcgtcctcaggcgtgtccccatatggatctgctggcattcgtttgtcagtgcacccaggggtagaagtccttggtctcagtctgcagacgtctgcctgagtgcagccaggtgcccccccagagtgggtagccttgtccacatgcccatcagcagcacctgaggggtcccaacagccctacatcccaccaactttctgcttttttccagtcaaatggctcttgagtgttacctggctttatttatttatttattttttgagtcgggtctctgttgcgcaggctggagtgcagtggtgcaatcatggctcactgcagcctcgaccttccaggctcaaacaatcctctcacctcctgagtagctaggactacacgcatgtgccaccatgcctggctaatttttaaatttttttgcagagaaagggtcttgctatgttgcccaggctgatcttgaactcctggcctcaagcgatcctcctgccccagcctcccaaagtgctgggattacaggtgtgagccactgctcccggcctgtctttattttgtattcttggattcctagtgagtttgagccccctctatacatcataacccttatgatactagtaaacatatattttatctttaaccccatttctggcacagaactcctaaaagccttactctccaaaatgatctctttctgtgtactaatggattgactgaaggctggcagcccctaggtagcttcaagatgggggctggtcatcagagagacataggcaggattagagggttgggactttcatcccaccatcccacgtactgggagggaagggggctaaaggttaagctgttcgccaatggccagtgatttattcaatcatgcctacgtaatgaagcctacacaaaaacccaagaagaccgggttcagagaacttctggtagctgggcacatggaggttcctggagggtgccaagccctggaagctctgtgctccctcccacatgccttgccctatgcatctcttcatttgtatcctttgtaatatcctttctaataaactggtaaatgtaaaaaaaa

SEQ ID NO: 351606 - DNA, 3229 bp, Homo sapiens
attggtcgacaggaccgggttgtccggccccacccccgcttccctttgccgcgctccgggtctcgggttttaacccaaggtggagagctggattccggcgggcggcgcttggttagcaggtggacaggcgtcctctttccggctgttgctgctcttcttcctccaatcctgggtctcagtcagggaagaacgaacattcttcctttgctgctggagcttttagagaactgttgcccagcaccttaggcacttcagacatttcatctcactcatttttgtaatttcactgtaaaaatcacctgcacatttataacactgtgactctccacttctgctcaatgctgaaaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagtttcggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcgttctggatcaacatggatgcagcaccggccagggtagctctggggataaccaccgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataagacagaagcttttgcactggagaagttttaccgtttctcagatatggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaatgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaactaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccag

SEQ ID NO: 351607 - DNA, 287 bp, Homo sapiens
aatccagagtcctcagacagtgctcgacacattgtacattttcaaaacctatttgaagatgaaaatgactcctgctcacttcataaggagaccacacagagtaatcgactgaactgtgaacactttaaagattcagatttgtgttttatatactttactgtttgtagcacagtgctttgcatcgaacaaattacataagaactcaaaaatcatttttgcaatatataccatatatttgattacattatggtataagaaaggatacttttacataataaataaatgca

SEQ ID NO: 351608 - DNA, 1413 bp, Homo sapiens
attggtcgacaggaccgggttgtccggccccacccccgcttccctttgccgcgctccgggtctcgggttttaacccaaggtggagagctggattccggcgggcggcgcttggttagcaggtggacaggcgtcctctttccggctgttgctgctcttcttcctccaatcctgggtctcagtcagggaagaacgaacattcttcctttgctgctggagcttttagagaactgttgcccagcaccttaggcacttcagacatttcatctcactcatttttgtaatttcactgtaaaaatcacctgcacatttataacactgtgactctccacttctgctcaatgctgaaaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagtttcggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagtatgaattcaaatgaaacagatggtctctcggctcctagattttgtttgctatatcctggcttgcacaatccaaaacttaattttttctgagttgtttttgaaaatctcacaggactttgaaatcttcaaatgcttcatatcttcagtttctttgttaacaaaaattgtgctagaaaaagaaaaaatcttgttgaatttacaaatggagcatctgttatgtttcatgagagatctggctttcctgcttttttaaagaaagaagaagaaggtccttgcaaagacgactaattgaacttacatatttatctgtatttcctctgaaacccccattaaaaaaggaaataaacatagatgcgaacagcctcccctgttctcattgcccgtccgcccctatcatctacattttcctc

SEQ ID NO: 351609 - DNA, 1602 bp, Homo sapiens
attggtcgacaggaccgggttgtccggccccacccccgcttccctttgccgcgctccgggtctcgggttttaacccaaggtggagagctggattccggcgggcggcgcttggttagcaggtggacaggcgtcctctttccggctgttgctgctcttcttcctccaatcctgggtctcagtcagggaagaacgaacattcttcctttgctgctggagcttttagagaactgttgcccagcaccttaggcacttcagacatttcatctcactcatttttgtaatttcactgtaaaaatcacctgcacatttataacactgtgactctccacttctgctcaatgctgaaaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagtttcggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggtaggggttgagtagtgttctttacacttactacttgtggttttatgatatccagatgtttcttcattacaatgctaagttatttaactgttcatagatcaatgtttttcttatatagcagaaaatggatgcatttgaaacctatgaatactttgattcattgcatattgttaaataattggtctgtatgagaccaaagtaatgcttggtgttcaattatctttaaataatttttaatgaaaagctcataattacatagtaataatgtttccaaaactattcctttaatttctgtgaacaataaaatgtgtttttaaccattcttgggcagtaaacactgtatctgttaagaacattttttttaaaattgcatttttta

SEQ ID NO: 351610 - DNA, 408 bp, Homo sapiens
taggacaattacatatacatacacacacacatgtaatatactatataatatatacatatattaagaaatgcctacatttctgtgtatatatacatatgtgtgtatatatatatgcatatatgtgtgtgtatatatatactcatacatacaaatctacatatatatgtgtgtatatatgcatgttttaagaacaatttgtatctatttttttcttttctccttaaatagtggtttaaaatgacaagataaaagattgtaaatcggtggaacccactggaaagtaggcaaaaagagtttaacctactggaaagcaagagctgtcagaatcccagggtccacttttgaatgaaatctgactgcagaaaggaagaaaagaaaatgttcaataatattaagacgtgggaagca

SEQ ID NO: 351611 - DNA, 3160 bp, Homo sapiens
attggtcgacaggaccgggttgtccggccccacccccgcttccctttgccgcgctccgggtctcgggttttaacccaaggtggagagctggattccggcgggcggcgcttggttagcaggtggacaggcgtcctctttccggctgttgctgctcttcttcctccaatcctgggtctcagtcagggaagaacgaacattcttcctttgctgctggagcttttagagaactgttgcccagcaccttaggcacttcagacatttcatctcactcatttttgtaatttcactgtaaaaatcacctgcacatttataacactgtgactctccacttctgctcaatgctgaaaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagtttcggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcgttctggatcaacatggatgcagcaccggccagggtagctctggggataaccaccgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataaggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaactaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccag

SEQ ID NO: 351612 - DNA, 903 bp, Homo sapiens
ggaaggggcaaatatccaaactgtatcagcactctttgaaagattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctgtctgggaaatttaggtctaaagccaaagagggagtgaaaagtgaagatcaactattaaaagccatatacagagtggttcaagaatcagatgaaatagctgaagaggcgaatgtagagaggaaataaaacacaaacaagaacagacgcttaagaaatgcctacatttagaagttgttggaaaaaattccagacaaaggcaaagatggcaaattaaaatcaacacgattcaacctcgaaagagaaagcactgtgaaggagttctgtgtaacaaaatcaaatgctgcaaagaaagttgtgtaaggtacttgaaaaaagcaattgttattgttaacgaagacaaatgtgattagaataatgatggtcaaagctggaatctaaaaaggttttttatagtggtttaaaatgacaagataaaagattgtaaatcggtggaacccactggaaagtaggcaaaaagagtttaacctactggaaagcaagagctgtcagaatcccagggtccacttttgaatgaaatctgactgcagaaaggaagaaaagaaaatgttcaataa

SEQ ID NO: 351613 - DNA, 899 bp, Homo sapiens
ttatgtcggcactgactctcttaactaccaccgctacacgattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaatttttttaaatggaagatgttctttattcaataaggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagtatgaattcaaatgaaacagatggtctctcggctcctagattttgtttgctatatcctggcttgcacaatccaaaacttaattttttctgagttgtttttgaaaatctcacaggactttgaaatcttcaaatgcttcatatcttcagtttctttgttaacaaaaattgtgctagaaaaagaaaaaatcttgttgaatttacaaatggagcatctgttatgtttcatgagagatctggctttcctgcttttttaaagaaagaagaagaaggtccttgcaaagacgactaattgaacttacatatttatctgtatttcctctgaaacccccattaaaaaaggaaataaacatagatgcgaacagcctcccctgttctcattgcccgtccgcccctatcatctacattttcctc

SEQ ID NO: 351614 - DNA, 486 bp, Homo sapiens
aacacagtgggacactgagagctagagcatctcgatgtagtacaccgtgacttaacacagcaggacacggagagctagagcatcttgatgtagtacaccatgacttaacacagcgggacatggagagctggagcatctcgatgtagtacaccgtgacttaacacagtgggacactgaaagctagagcatctcgatgtagtacaccatgacttaacacagcgggacactgagagctagagcatctcgatgtagtacaccgtgacttaacacagtgggacactgagagctagagcatctcgatgtaatacaccatgacttaacacagtgggacacggagagctagagcatctcgatgtagtacaccatgacttaacacagggggacacggagagctagagcatctcgatgtagtacaccgtgacttaacacagcgggacactgaaagctagagcatctcgatgtagtacaccgtgacttaacacagcg

SEQ ID NO: 351615 - DNA, 599 bp, Homo sapiens
tgtagtggctcacgcctgtaatccctgcactttgggaggccaaggcaggcggatcacaaggtcaggagatcaagaccatcctggctaacacggtgaaaccccgtctctactaaaaatacaaaaaattagccgggtgtggtgatgggtgcttgtagtcccagctactcgggaggctgaggcaggagaatggcgtgaacccgggaggcggagcttgcagtgagccgagatcacgccactgcactccagcctcggtgatgaagggagactccgtctcaaaaaaaaaaaaaaaaaaaacaaaaacatggcattaggaaacaggaaaccaaagaaccaaccaagcatctaaggaggggtgacttaaatttaacgcaaaacaataaaggtaatcacttctagttttaaaagatagttaagagtctggccatatccctagttgtacaacagtgactatctgtcacaaccaaggcactggtacaatatcagtgtgcttctctctgcctccataaaaattattttgaaacagaccctcctgggaccccagaaggtagtgtgtcactattccctcccctcattcattttgctaagtagtttttctgcca

SEQ ID NO: 351616 - DNA, 2838 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaatatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351617 - DNA, 925 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtgtaatttaacagaatcaggatgacttgtgtgcttaacgaaattgggagtcaaactgctaaaggtcagtttgaaggacaacgggggttttttttaaaaggctcgggggagaaggctaaatacagggggtcgtccgggttcgttcaccacagttggggtttgcagctgtccttagaagttgaaatgggggagagggcgtctgggggggtacggtattgtttgtggtttct

SEQ ID NO: 351618 - DNA, 4076 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351619 - DNA, 3326 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351620 - DNA, 3996 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351621 - DNA, 2998 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttcacaacagacaaacacaacacaa

SEQ ID NO: 351622 - DNA, 2138 bp, Homo sapiens
aggagaattgcttgaacctgggaggtggaggttgcagtgagccaagattgcgccactgcactccagcctgggcgacagagcaagattccgtctcaaaacaaacaaaccaaacccttatcactgaagaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351623 - DNA, 1086 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351624 - DNA, 3000 bp, Homo sapiens
gcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccgcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351625 - DNA, 3079 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351626 - DNA, 2975 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351627 - DNA, 3892 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351628 - DNA, 3818 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 351629 - DNA, 3636 bp, Homo sapiens
accagtctggaaggtccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctctcttttccttcgcttttctgggcctgccgtgctccgggcatcactgctccatagct

SEQ ID NO: 351630 - DNA, 758 bp, Homo sapiens
aaatacattacaggttttgcaaaagcagaaacttcaacacaggaaaacttttaaagtaaatagactagcgcggcacttacctctctctaatggtgggataaagaccctgccagtttggggccgggataaggttgttgttactgagattctgctggtggtactgctggacgctggtgctgctggagttggctggctttttacgggggaatatatcagcagccatcttcttctttttagtcttcaaggtaattatttcataacaaactggtggcaacttgctgctgttgctactgctgctgctggtatttgctttctttgagcttttcttggacctgttctttaccgtctctggaagcatcaagaagaaggtatggcaactggtgtcagaagtataaggggtttgtgaaaattccacagtaaagaagtggggcaacacctggactacgaggcggatctcctggcttgtcatgttgtttgcttcattcactctaatattcactcacagtaattacctcacacacttacagaatgctcaattgtcatatttctaatctactttaaaagaagagctttcttttaaagtttacaaagatgaaaaccatgaacatatgtagtctgcacccctgtaggggcacactacaggcaagaatgctgaaaggatacttgtggaatgagatggaaggaaggaactgcagtgaggacgctgctcaaaaacagaagaggctctccaggtacttgaaaatagtctatccaaagaa

SEQ ID NO: 351631 - DNA, 517 bp, Homo sapiens
  misc_feature (9)..(9): n is a, c, g, or t
  misc_feature (12)..(12): n is a, c, g, or t
  misc_feature (14)..(15): n is a, c, g, or t
attcgcggncgngnngacgaaaaagagttgcatttaatacaatctgacatattcactttgcagacctgaatgaggtttgaaactgaacgggactccagaaatcatttaatgcaactctttttcacaggtatggcaactggtgtcagaagtataaggggtttgtgaaaattccacagtaaagaagtggggcaacacctggactacgaggcggatctcctggcttgtcatgttgtttgcttcattcactctaatattcactcacagtaattacctcacacacttacagaatgctcaattgtcatatttctaatctactttaaaagaagagctttcttttaaagtttacaaagatgaaaaccatgaacatatgtagtctgcacccctgtaggggcacactacaggcaagaatgctgaaaggatacttgtggaatgagatggaaggaaggaactgcagtgaggacgctgctcaaaaacagaagaggctctccaggtacttgaaaatagtctatccaaagaa

SEQ ID NO: 351632 - DNA, 326 bp, Homo sapiens
tgtgattaaaccctaagtctacaagaaaaacattaaattgtgttcaaaactatctgttagaaaggaagaagtactgccttttggtaaaaaggacccttgatcctttttagagctggaaaagaaccttaaaagttacttggtctaaccaccttaatttacaggtgaggaaactgagtctcaaagaggttaattgatttgtccaaagtcatacagctgcccattggaaaaactgctgggactggaatctcagagtcccaattcctggtttagtcatgttcctacttctgactaaaaagcacaaatgttagtactatgaaaaactcatt

SEQ ID NO: 351633 - DNA, 600 bp, Homo sapiens
agatcctacaagacactccagtgcatttggcctgagtgttgcaggccagggcaggtgtgcaggtgcaggtgtgcgtgctgcaaacaggcagatgtgagatgtaggggattttcctatttcagattacaaagctggaacagaggtgagacagaccaccgatgagagcttcaacaatcccagcacctaccagaaagctaattacctaaagcaaagcagctgacaaatgggctagacttgaggaccgcacattcgtttaaatgtagagaaaagaagggtaggcacttatggcctgtgaccctaaaacaggataaactctagagggaatagtcggttctgcaagaagaaatgaatcgtgactaattccagagaggtggcaacagggacggatctaaaggagctattgtgtttcccatgacatgttctgtttagaaaaggacaagtacaaagatagaaggaagggcacagtaccaaggacaagctgagaagagtgacacatttctgtgagaacagtgcccgacttgagctgaggcttgcaaaaaaattgctaaagttggcaagaaaaaaaaaaggtggtggtgaattatttttagttatgattaa

SEQ ID NO: 351634 - DNA, 797 bp, Homo sapiens
tgctgggattacaggcgtgagccaccaggcccggctgtctgtggtttttctttctggaatttctgttactcagatggtggacccagaattacctctcctccctgtgtgccccaaccccaattttcttttcttttgatcataatttatggaggattactccaagttgattctctgattgttcctttatatacgtagatatatagggacagtaccttgttccttgttgcaacatctttgaggatattaatatgctctgtagaagctttcatctccctgcatatgtctttctgctttctgttcttcaatttaatctttcatgttacagactttctttagctgcctggcaatcgttggtaatcttgcttatatttaagagtggagtattaaaaagaatatgtgattgtaaggtgatctcattgagcttctttggggaaatccccagtgtccatacttctagaactttgctccaggctggacaggttctcttggagaaacttttggtttcacatcaggagggtttactctgagctgctggattgagagctctgttggggaagagggtgagaatttcagcattctagtatgtccacattcagttccttcatccaggtctctgggagggctcctagtccagaaaccttctaaccccctctggagaataagcttccaacttttttgccaagattggggaagtcaggtcatgtggaaatatgaatgtttcagcatgcttttgctttttttctttgaaaatatattactttaaaatgaaaaaaaaaaaactcgtgccgaattcttgg

SEQ ID NO: 351635 - DNA, 451 bp, Homo sapiens
gggctcctagtccagaaaccttctaaccccctctggagaataagcttccaacttttttgccaagattggggaagtcaggtcatgtggaaatatgaatgtttcagcatgcttttgctttttttctttgaaaatatattactttaaaatgaagaataagactgggggtggtggcttatgcctgtaatcccagcactttgggaggctgaggtgggcagatcacctgaagtcaggcattcaagaccagcctggccaacatgacaaaaccgtgtctctactaaaaatacaaaaattagctgggtgtggtggcacatgcctgtaatctcagttactggggaggctgaggcaggagaatcgcttgaacccaggaggtggaggttgcattgagctgagatcgcaccactgcacaccagcctgggcaacagagcgggactctgtctcaaaaagaaaaaaa

SEQ ID NO: 351636 - DNA, 719 bp, Homo sapiens
tgctgggattacaggcgtgagccaccaggcccggctgtctgtggtttttctttctggaatttctgttactcagatggtggacccagaattacctctcctccctgtgtgccccaaccccaattttcttttcttttgatcataatttatggaggattactccaagttgattctctgattgttcctttatatacgtagatatatagggacagtaccttgttccttgttgcaacatctttgaggatattaatatgctctgtagaagctttcatctccctgcatatgtctttctgctttctgttcttcaatttaatctttcatgttacagactttctttagctgcctggcaatcgttggtaatcttgcttatatttaagagtggagtattaaaaagaatatgtgattgtaaaacaaaaaacaaaaaaacaacaaaaaaaaaaaaaaaaaaagagggggggccgcgccccaaaaattcccccgccggggggccccagttttgcgcgcgttccccggttttcttgcgttcccccggtgtggtcgcccctagtagtgggagcgcgcggtgtaataagagcaagaggacgcagggcgccggcacgttgttcacaccaccgttcgtggcccggggaacaaccgtgcctgcccctgggggacccctggggcgaaaggaacccttatccttccgggggggggggccccactatgtgcgcccacctttacca

SEQ ID NO: 351637 - DNA, 715 bp, Homo sapiens
cacagtatcaacagtggtgatgagagctaccgttgactttgccatattttgcagagcggtgaagacactagctttggagaagtacaatggcaaggtcgcacagctggaaagaaacagaattgggatttgaaccaggtcccgtctccgctgcgtgtagcaccctgctttgtaggcacttagtaaacgtctgtttgatggatttctgaccatcagagtgacccagatttcaacccaagtatttgccagagtctcataggagtgccctggggctggaagatatgtcgttgtagaaggcaggatcacacctggtagaagcagagcccagcgaccctgtcccgggtctgctgaaccaggcctctgcccaggacctttggaggagcatctgggtgtggctggactaggcgaggaatgtgcttatttattctcagcataaagccagaaggcaagaccctgggtaggtctgtccgatgagcttcccttgtcctctgtggtaaccctgaggctctgtgacctagctgagggccctctgtggcccacctcaccttgtctctccagcctcacctcgaagcttccagccacaccctagcgtgcctccagccttcaggcctttgttctttctgcccagagtattacttcttgccttacccctttcttccccgtgcatccttctagattccatttcagcttccctgagggcacgttgggctcactcttc

SEQ ID NO: 351638 - DNA, 1135 bp, Homo sapiens
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaag

SEQ ID NO: 351639 - DNA, 1101 bp, Homo sapiens
agagatatgacttgtcatcagtttatttgaaagtctactggtatgagagtaagggagagagccaggcccaacctcagttggccttactcaattctttcattttctggggacagtactagattaattataagcagcatccccttcccccatgcccacttttcaagcttcaacttttcttgagttcctaagcaggagacctggacctccagtgaaaaccatactcactgctcctaagcagaaatcccttccttctcacctgttccaccagcccaggctataccctgggcctgtcagcaacactgcctcctctagcgcaggtctcactctgaatctcattggcaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttggtgagtcaggggagccaaagagcaaatccccactccagtggccccagatggaccactgtagggcttcctgggaggcatggggcactctcggggaggaggagagaaaaacctcaggacaggtttgattcatttttccttgatccaattctatttgggagtgagcctaggtcaacagatatccaaattaacaatcttaggacatttaacacctcttctgaagttagtgagtctaagctttgaagagaaggaaaactagagatttttcctatttccttcattttgtcctgtgatcaacctaaatcagctcagctcatcttgattatatctccgaaattaggcttcattggacttaagaaaaaagagaatgtattaatataaagaatggggcaggagttatcaggagaatttttcaactttcataatgggcaggacaaaaaaacttccactcatagctcc

SEQ ID NO: 351640 - DNA, 1082 bp, Homo sapiens
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaag

SEQ ID NO: 351641 - DNA, 929 bp, Homo sapiens
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttggtgagtcaggggagccaaagagcaaatccccactccagtggccccagatggaccactgtagggcttcctgggaggcatggggcactctcggggaggaggagagaaaaacctcaggacaggtttgattcatttttccttgatccaattctatttgggagtgagcctaggtcaacagatatccaaattaacaatcttaggacatttaacacctcttctgaagttagtgagtctaagctttgaagagaaggaaaactagagatttttcctatttccttcattttgtcctgtgatcaacctaaatcagctcagctcatcttgattatatctccgaaattaggcttcattggacttaagaaaaaagagaatgtattaatataaagaatggggcaggagttatcaggagaatttttcaactttcataatgggcaggacaaaaaaacttccactcatagctcc

SEQ ID NO: 351642 - DNA, 507 bp, Homo sapiens
taatttccctgctctgtgagctcccacaccagtgtccagtacacttgccccttctcaatacattagtcaagataaagatacctaagcatatagggttttcttgctctttcagcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaag

SEQ ID NO: 351643 - DNA, 994 bp, Homo sapiens
  misc_feature (885)..(885): n is a, c, g, or t
  misc_feature (894)..(894): n is a, c, g, or t
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccaaaattgccggtggggtcatgcccaccgncgagtttgnggccaccgcctgtgtttcgggtcgcatccacgcgttttccctcggtacaaattagttccccgcgattttttttcatttcaagggggggcttctctagctg

SEQ ID NO: 351644 - DNA, 1307 bp, Homo sapiens
agagatatgacttgtcatcagtttatttgaaagtctactggtatgagagtaagggagagagccaggcccaacctcagttggccttactcaattctttcattttctggggacagtactagattaattataagcagcatccccttcccccatgcccacttttcaagcttcaacttttcttgagttcctaagcaggagacctggacctccagtgaaaaccatactcactgctcctaagcagaaatcccttccttctcacctgttccaccagcccaggctataccctgggcctgtcagcaacactgcctcctctagcgcaggtctcactctgaatctcattggcaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaag

SEQ ID NO: 351645 - DNA, 1081 bp, Homo sapiens
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaag

SEQ ID NO: 351646 - DNA, 640 bp, Homo sapiens
cagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagt

SEQ ID NO: 351647 - DNA, 1910 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 351648 - DNA, 1806 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 351649 - DNA, 1419 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtaactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 351650 - DNA, 829 bp, Homo sapiens
tgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccag

SEQ ID NO: 351651 - DNA, 445 bp, Homo sapiens
ccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttcccca

SEQ ID NO: 351652 - DNA, 1964 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 351653 - DNA, 1757 bp, Homo sapiens
tgtagtgatcatgctcactctgcatgttgcctgaagattccagtgtactccgcatagacaatcaagatgtcttaaacatatctgaacacacaatagctaagaccccaactgggattcgataccccactatgcttagccctaaacctcaacagttaaatcaacaaaacggctgccattgggctggcagccgtgcccgatgtcaaggccgagcttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 351654 - DNA, 1191 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggcagggcagctggaggagggacctggagccgaacaaggggagctgggaccacgagcaacccaggtgacatcctggactctgtcaaagataagcaaagcaggacgctaattaaagcagtcaaaacattttattcagt

SEQ ID NO: 351655 - DNA, 1593 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcaggctctgctgacccttcgggattcgcggctagctgtgatgtgtccgccaagatctcttctcttgtctgtaaacaacttcactctcaaggaggcagctctggcctctcagcaggtgcggcctacagtgatgtccgtccgggttttacatccttccccgacctcgacatgagtcccagccccctcgggcctctgactctcaggtgtcccctacgatcgccgtcctctcctctcgctcctggctcccctacactgtcacacacccacacaatcacagacgcacacgcatgtacacgtgcaggcttggaaatctgctttacctgacgcactccgcctgccgaaggcccctcacatctcccatttcctctgccatcatcccagactgcaaagctgtgttatttgttgttgctgcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttacaacaacacacgagattccaaaattatgtcgttttttagatgcaaagataaaaatgttgtaaacaccaaaatttaacagcttttcttatggggaaaagtggggagttagggataacagatgattattattttcttctctacatattggcagttacccagttactacaattaagcatgtcctatttttataataaaatgccagaagcattttaaatgttagaaatctagaatggtaacataagtatatgcaaataaatactcgttttttacatttaaaatgtcagaaatttagctttcaaatttgtcctaacaatgacagtaaccagtgtttactaagttctgacactgtgtgtgggcactgttttaagaattttatgagttatcttattaaatcctcactatcattcctccattgaacatctaaggaaagggagttatagggggttataaactaaaaataacctcctaagccccaccacagccaactgaatggacccctcttggccaagagggccccagaaaccttaaaaactgcgttctcagccatgatgggaagggaggtcgaacatgcctcactaatacccttgtgcagtttagacacaacaactaacaagcattaatgttaaaatagagatcataagactgacagaatggacgctgtggcagtaagataccaacttacaaacaggacctaaggccatgccaggcatgagttaagtcatgcatccctacacttaaaagaataaactatattttaactacctgg

SEQ ID NO: 351656 - DNA, 989 bp, Homo sapiens
tggatttatactttcagaggtagtagacttttagttttattagttgacatttccagaatttgaaagcttagctaaatatttattttatcttgtgtgactgttccttccaaatgtatccagtcttaagtggttccccaaattccagctcttcgtgcgatccaaccctaggtctggctgcggaggtggctctccattgttcttggaacgctgcatttttgtctgagtgatgggtgggcaggaagttgttaagcaggtgttctactagactttgagaaaagaagattaaagcagacaagcctacataatcaccagttataacctggagaaaagcaggaataattttcttaccctcattgggattacgtcacccggcctgtagaccatcaggggcctgagaggcattagagtctctatcgtagaagaacgaggaaatcatccactgccagagacagtgcattcacagcccagtggcccctcgctcactctccgggagttggcagggacccagctccaggactgcaattctgtgacctttggagctgtgcttcctccactcctgccggtggctgagccctgggtggctgccctctgcagccctggtcggcagaggcaatgcagaggctggctgttttgtgacggtcctaggttccccactctccagcagctttcaggggatgttaaacattcatttacccaaaagattctaaaattcccccttggcccctgataagcaagaaacttccatgcctctcaagttgttgactgtggaaaacgtttgcagacctttgaaaatgtggtttttaagagagaagaatatgaaaagaggtggtgggccttaaacactcatccgcttgacaagaaactctcaaatcagtaccagtaaccagtcattataaatctgaatactactacttcttgtctttctggttagagaaatatacaaacagctcaagaaaatggtaaattataaagatggaagtgactattga

SEQ ID NO: 351657 - DNA, 1175 bp, Homo sapiens
caccggctctctgacctggacctcgccgtcgctggcccctgaaatccatcacttttgtcggctgttctgtgacgccacaacgaggagccacctgggctctgctgacccttcgggattcgcggctagctgtgatgtgtccgccaagatctcttctcttgtctgtaaacaacttcactctcaaggaggcagctctggcctctcagcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttacaacaacacacgagattccaaaattatgtcgttttttagatgcaaagataaaaatgttgtaaacaccaaaatttaacagcttttcttatggggaaaagtggggagttagggataacagatgattattattttcttctctacatattggcagttacccagttactacaattaagcatgtcctatttttataataaaatgccagaagcattttaaatgttagaaatctagaatggtaacataagtatatgcaaataaatactcgttttttacatttaaaatgtcagaaatttagctttcaaatttgtcctaacaatgacagtaaccagtgtttactaagttctgacactgtgtgtgggcactgttttaagaattttatgagttatcttattaaatcctcactatcattcctccattgaacatctaaggaaagggagttatagggggttataaactaaaaataacctcctaagccccaccacagccaactgaatggacccctcttggccaagagggccccagaaaccttaaaaactgcgttctcagccatgatgggaagggaggtcgaacatgcctcactaatacccttgtgcagtttagacacaacaactaacaagcattaatgttaaaatagagatcataagactgacagaatggacgctgtggcagtaagataccaacttacaaacaggacctaaggccatgccaggcatgagttaagtcatgcatccctacacttaaaagaataaactatattttaactacctgg

SEQ ID NO: 351658 - DNA, 509 bp, Homo sapiens
tacacataattccaccactcgctgacaaccattgttggcttagattttagcttctttctttctagaaatagatcctatagttgcctagttacatacgtagatatttaaacattctttgaggttataatgacatgcagttttgaatgatgtgttatttaatgtgtcataagcattttccgtcattaaaatctcccaaccttttttttacaagatgtcattcgtatggatgtatttgaattttctattttttctcaatgatgatgtgacatccattttactttataagtatctttttacttttcaaattattttttgccaatagattcctagaatttctggatcagaggatctgtgtacctagccgttcatgaaaatgcatgaatgctaatcattctaacacagtggccaggtgggaatgtcacccaggatgtctccaaggcagtggaagagagagccgccaggcaccctcgtcattaggaagcctggccccacttcacccagactgcccg

SEQ ID NO: 351659 - DNA, 361 bp, Homo sapiens
ttggcattgccatggtggtggacctgctcagcctcactcatgtttgctctttcagatccgaacgacgtcaggtgctcctccaccctggtgacgcactcaaaaggctatgagaatggtacaaacagattgagactccagaagcaaatcttgaagagcgaaaagaacaagcctctgaaggggactaaagcacctgccccacaggtgatggggcctgagcaggcagcccagggctactgggctggcagtcagattcctagtaatggggggaggctgccatccacaaagcgcgccactctgcactgaccacctgccctcagaacaccttacgtgtgcacacgccagccagactcagagatgaatt

SEQ ID NO: 351660 - DNA, 5584 bp, Homo sapiens
  misc_feature (61)..(61): n is a, c, g, or t
  misc_feature (287)..(287): n is a, c, g, or t
  misc_feature (506)..(507): n is a, c, g, or t
cggcggcgcaggtgaggcgcggggccggggccggaccgggaggcggggaccccccgccccnccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctanaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcnnattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351661 - DNA, 5650 bp, Homo sapiens
  misc_feature (61)..(61): n is a, c, g, or t
  misc_feature (287)..(287): n is a, c, g, or t
  misc_feature (506)..(507): n is a, c, g, or t
cggcggcgcaggtgaggcgcggggccggggccggaccgggaggcggggaccccccgccccnccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctanaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcnnattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagctctttgcctggaaggtgcctgcctgcctgcctgccggcccttgaacttaaatcgtctgaagttgtagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351662 - DNA, 3991 bp, Homo sapiens
gatgattttcatattgtgtgttctttattttatatacatattacgtgcatatacaagcatttatttttttgaacgctggttcatttttatagttttaggcttctaggcactgtttcccctgatctttttcccctcctattgtcctcattttggcttttttcccattgtctatgcaacattttcaaaaccagagctcctggcggctgctcaccgaggacctgcgccagccttggtttctcagctctcccctcctcccttcttcccctggcgtttgctattgatcaggttgaattttaggtcctgcagagacatctgacaggggtcccaggaaggccctggctgtcgaggaatccagcagacacgtggatgtgtctgggaaggaaggccggcgcagctcagggcaggggcgcgcgttgcgcaccttcacgcctctcacgctggctgctctggggcctcagggaggagcaggactgtgcggaacaaacgttttttatttgaagagaatcctaagagttcttgtaactagaaccaagcatttctgatgacttttgactcttaaaaacccttgaagttttaactctccaaggcaagcttggggtggagtttaaataatgggaaacaccctcacgatgagttgttttgcagagcagtttgagtaaatggtcatacagaggcttaggtttacttctcatgctgtggcgataactgcacgtctgtttttcctctcttctaggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351663 - DNA, 4282 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351664 - DNA, 4663 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351665 - DNA, 4853 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagaaaagtctgcaggaactgctgcctgagccaagcttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351666 - DNA, 3092 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagac

SEQ ID NO: 351667 - DNA, 1996 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgagttcattaagacttgttctgctgcaacaataatttcgcaaggcgcatgatctctgagttgattcactgctcaggggaacagggttccccaaggtctcatatcccctgagtgggcccagcccaagagggtcaggctgtcacctgggggtggttttattgtctcccgtccctccccagggccctgactctgcacttgaacagcttccctcagaaatagcatgccagctggactcaggggctcatgcctgttatccagcactgtgggatgctgagttgggaggatcgcttgaggtcttcttgttatgaagaccaacccgggcaacataacaagacccctctctaca

SEQ ID NO: 351668 - DNA, 776 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactgcataaactcaagaggaatttacaacagatgggctcaggcaacaagttagccccagagtggagctcagctacagaggaatgcttcactgaaagaaatgacagacaggtctgtcccacccacggtgactcagtcattgttgttcatggccgctgcccgttcttcacgatcaaggaggagaaatctttggaggaaacagagctttcatacgtgaatcgactgggaagcgagtcaaaagtactgcaactggaagtgtggcatggggagggggccgtggccagtctcctcactgggctcctgtaggactgggaacgcctactccttcacacctaattatgtttgctggattgggttatagttcttcagtgtgtggactcttgtcagttttatatccgtaggccgagcacaatgcctggaatacagagcatgcttaataatcaga

SEQ ID NO: 351669 - DNA, 463 bp, Homo sapiens
ggttatgtctttttattttttcagattgtgggatatttgcattacactggttgagcatctcaaatcccaattctgaaatgccccagtgagcatttcctttgagtgtcagcactcaaaaagttacaaattctggagattttggatttcaggttttcagatttggaaggctcaacctatactaggccttgtacccgctcccaatctgataggccaggatgaggtagtgtagttccatatgtgttcctttcattgtgagtgaggtgttgagccccattctctgtggctgctagttatgtgctgggattttctctaaacagcaccatgtgtgtccatttgcctgatttcaggagcagccctgggccccctgctggctgggctcctctccccgtccggctggagcaatgtgttttacatgctgatgtttgcagatgcctgtgccttactggtaagtcggcctattttt

SEQ ID NO: 351670 - DNA, 403 bp, Homo sapiens
ttgagccccattctctgtggctgctagttatgtgctgggattttctctaaacagcaccatgtgtgtccatttgcctgatttcaggagcagccctgggccccctgctggctgggctcctctccccgtccggctggagcaatgtgttttacatgctgatgtttgcagatgcctgtgccttactggtaagtcggcctatttttagtccaatccaccttgaatgcagatctctgtggttgtgtccaaacactggtggaactttctcccatgcattcctgagttatcagagaggtttgggtcttcccatcttttctaaatatgcgtggtctaaagctccttctctctctgattagaaaaagtcagaaacagaagcaggacagtcttgctctgcagccttgggcgggat

SEQ ID NO: 351671 - DNA, 886 bp, Homo sapiens
gcagggacagggcctgccccaagggccagtgactggggaggcagcaaggagcacccttggatcctgaggttccttccctgccttgtgacccccgcctcactttggccagtgagctgcacacagctgggccttctttctcccttcttcccctgtggttgcaaaaggggtgacgttctcaggacttgagtcttgaactgctgacatttccagtctgtttgaaaaaagcaaaattttctgtccatgccattgatgattcggaacggctgggtttgacccacagccccagatgccgtgcagtttcctctcccacacccggctggctcagtccaccttaaagcccagaacctgtacaaaacctcatggagggcaccctgagctggtgccgggaggcctctgtgtcctcatctgcagttctaaagccgtgtgacaggatgatcgagcatccaggcgccttccacacctccacttctgtcctgtgttaatctaactttatggcggaggggcccctgggggggtctctgaaccaaaggtgggataattagactgagcagaggaaagccacggtttttggttaagagtgttttcatcctttctgtgttacttgttttttaaatctgagttaactactaattgctcctcggtataaatcaagcttatgaagccagagtcccgtgcacgggtcctgttctgccatggtgtgtcgctgcgatgcgtgaaggagatcctcactgtttcacactccgttgtcatttcaatagatcaccttgatgccaaaaaggcgggggagctctccaccctgtttgacgtgggcggaatctttggtgagttcattaagacttgttctgctgcaacaataatttcgcaaggcgcatgatctctgagttga

SEQ ID NO: 351672 - DNA, 496 bp, Homo sapiens
ccccgctaacaccccagcccgcggccccaggtttgaatttccaaaggaggaattgctaaagcctgccctttccgggtctcccttagctctttgcctggaaggtgcctgcctgcctgcctgccggcccttgaacttaaatcgtctgaagttgtgtaagtggataaatattttagacttcccccgttgtttttttattaatcccctttgagagcaagcttgaaaacacctggccccagacctgtgattcaccaagtcattttggacctgcatttacacgttctgtttcatgcagcccacctgtgatgttctctttgttgggggttggaggcaggtaagggaggtggtgcaaatggaattcaggttccttgtacttcagccaaggggaaagagatagtgaccattttcattcatctttaatatggaaagcgcctttaaaagcaaaaagccatagaaagagcacactctggacaggaagttgtattctatctcgtaattt

SEQ ID NO: 351673 - DNA, 483 bp, Homo sapiens
acgtggcaatattttttaatgttccaatattatagtgacataagtaatattgataatggctgtagaactgaatgaataatacacagcataagaacgtttcagaacacagtgatatgtattcctaacataacttctgttatttcatatcatcctctcccactgttttgtgtttcaggtacagagccttcatttttattttgacatttctgctgtatgcaagttttcacttatctcgaaagcctatcagcatagttaaggtaagaatcatggaaagcactgcctgtcgtctctgtgaggagttcgtcacttgaaaagcttgtggggcagaggatggggatggtagcaggtacatggggaaacagattatgtagaaacaagttattctgctgctttggcttttcggtttccctttgctaaaattaaagtcttttaaatgttttttggatttatactttcagaggtagtagacttttagttttatta

SEQ ID NO: 351674 - DNA, 751 bp, Homo sapiens
gtgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactgcataaactcaagaggaatttacaacagatgggctcaggcaacaagttagccccagagtggagctcagctacagaggaatgcttcactgaaagaaatcttttctatggacctctggttttagagacaacatctagttctcttacatcccttgccacttcccctgatgctgtaggacagacaggtctgtcccacccacggtgactcagtcattgttgttcatggccgctgcccgttcttcacgatcaaggaggagaaatctttggaggaaacagagctttcatacgtgaatcgactgggaagcgagtcaaaagtactgcaactggaagtgtggcatggggagggggccgtggccagtctcctcactgggctcctgtaggactgggaacgcctactccttcacacctaattatgtttgctggattgggttatagttcttcagtgtgtggactcttgtcagttttatatccgtaggccgagcacaatgcctggaatacagagcatgcttaataatcaga

SEQ ID NO: 351675 - DNA, 521 bp, Homo sapiens
gtgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactatgtaaccttcctagggatgctgtttctaactgctgccggccccttcttaccatctctctggttgtgcttctgacgcattccctacacaactggaacgtgtttccaggtcagcctccctaagcacctcccaaggcctccaccccacagtgtcgcacagaacttgacacataccagatgctccaattattaaatattactgagtacttttagaaaattgggaacatacaataaagtataatgaagaaaataaagaaaaccaataatctcacttcccaaagataataa

SEQ ID NO: 351676 - DNA, 5015 bp, Homo sapiens
gtgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351677 - DNA, 5116 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351678 - DNA, 3684 bp, Homo sapiens
gatctaaggatcccctggtacgggagtggacggcgccatcatcacagggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagcacctccggttggaggcacccaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351679 - DNA, 4959 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggcttgccagccacagagcgccccgaagtcaccgtcatcccagcccctggccttcctgccgccctccggggccatggcgctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351680 - DNA, 4978 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttccggactgacctaaaaactaattgtcgagaagccaagggtgaggaggcaggaagttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctg

SEQ ID NO: 351681 - DNA, 2216 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccatcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactggaaattctaaaactcaacttccccaccacatacaaaatcaaataccaactctcaacctatgaacttactaggtttaagtggctgttctttggatcatctgtgggttcttttaatgcctgaatgttctaatgaagcctccagatggatttccactaagtagcagtaaaattcctgtcattac

SEQ ID NO: 351682 - DNA, 1859 bp, Homo sapiens
ctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacggtaaggaccctgttttcttgtccttttctagaacagtgtgcggttctgaccacttccccagcctgctcctgcctgtgcggtgtcagacagaaacacacagggtagacagaagtcccaccctcaaaacattggcagttctaggaatagagaatattctgttttgggtttcgctgataataaccttatcagcaaaacccagacaagaggttcaatgctgtccagatgaaggacttcatgctaaggggaaccaaaggctgggccctggccaggcctcctcaggagtggagacctcctggtttccccaggggcctcagtgtgacggggaaaaacgcacgtgtcagctgcctgccatcacttaagttggtggctgcacgtctcaggtggccgagaggtctgcccagcacgccattccttctcttctgtacccctgcccagctcagccagcgtaggccctgcaggcaggattgctgaccacgttggctgccatgaatgagccctgccctagctgcctccacccgcagccagtcaccactggccactttcccacctggctaaggccagccctcccgcggtaccg

SEQ ID NO: 351683 - DNA, 474 bp, Homo sapiens
attaggaagcctggccccacttcacccagactgcccggctggtaacacctttcctttttgttcccaatggatttgcctccaggacccagagatgcagtgcctgctgctctcagatgggaagggctccatccacccgaaccacgtcgtcattctccccggggacggtgggagtggcacggccgccatcagcttcacaggggccttgaaaattccagtaagtaaacgtgcccaggaggagtttcagaaagggctgctgtgctggctgtgggaagtctggtcggttgatgattaagcttaaaaagacatctgtggttgtagaacccggggattcgaatccatagccaaagctagacgctgcacagtgctagcttcaggactgaatatggctgcagtgatatttgttcgcctcataccatgtttaaattttttttgaaattcgttttctccatttagaaattcaggttcatagaaaaa

SEQ ID NO: 351684 - DNA, 3434 bp, Homo sapiens
tgcccaggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351685 - DNA, 2123 bp, Homo sapiens
cgtgtgtgtgcctccgtggctctccttcgctctgtgggacgacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351686 - DNA, 1688 bp, Homo sapiens
atccttaattaaattaattccccccccccgagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351687 - DNA, 1794 bp, Homo sapiens
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtaaaaaaaaaactcaatatcctactacccacaataactacacaaaaaaactcgcggggggcccggtcccaattcgccctaagtgaggcgatt

SEQ ID NO: 351688 - DNA, 1506 bp, Homo sapiens
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatcca

SEQ ID NO: 351689 - DNA, 940 bp, Homo sapiens
ttaatactatatttgtttttcatccacagctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351690 - DNA, 961 bp, Homo sapiens
  misc_feature (919)..(919): n is a, c, g, or t
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagatcaggctacacaacaggnatgtttgagtggtacaggtctcttctactcatactgaaattg

SEQ ID NO: 351691 - DNA, 1637 bp, Homo sapiens
tgcccaggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagaacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351692 - DNA, 868 bp, Homo sapiens
atccttaattaaattaattccccccccccgagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatgggtaagagcagataagactgtatacgtcttccttcaccccctctgtgaaaacgctgcttcctaggctgtaagctttttgtttgtttaaagag

SEQ ID NO: 351693 - DNA, 2691 bp, Homo sapiens
  misc_feature (2649)..(2649): n is a, c, g, or t
tgcccaggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagatcaggctacacaacaggnatgtttgagtggtacaggtctcttctactcatactgaaattg

SEQ ID NO: 351694 - DNA, 2236 bp, Homo sapiens
tgcccaggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagcagtggggtaccagcatccctggaaaaagatgtcttgaatatcctacaatgaatatcaaatggagagagcctctgcctgttcaaggctgaaaatctgagaaaaataaaactcacgttgctttttaaattc

SEQ ID NO: 351695 - DNA, 232 bp, Homo sapiens
ccccaaagcccgcacgatgcaggccactgccgattccaccaagatggactgtgtgtggagcaactggaaaagtcagggtattctctttatttcagtagtgcatgcctgaggcgcacgggaaacccgggacctggactcgtccattgtgcatcatttcacctgtgggacctgtgcatgctttataccccagagctttgtgttggggggtagtaaacctcttatttcaagaatc

SEQ ID NO: 351696 - DNA, 1704 bp, Homo sapiens
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351697 - DNA, 1451 bp, Homo sapiens
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgca

SEQ ID NO: 351698 - DNA, 1536 bp, Homo sapiens
atccttaattaaattaattccccccccccgagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351699 - DNA, 1215 bp, Homo sapiens
atccttaattaaattaattccccccccccgagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggatggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgta

SEQ ID NO: 351700 - DNA, 2614 bp, Homo sapiens
tgcccaggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatgggtaagagcagataagactgtatacgtcttccttcaccccctctgtgaaaacgctgcttcctaggctgtaagctttttgtttgtttaaagag

SEQ ID NO: 351701 - DNA, 918 bp, Homo sapiens
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggatggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaatttggcggtgctgcgcatgatggcgagagcccgtatcttatcctctacggggaccttctttttt

SEQ ID NO: 351702 - DNA, 1204 bp, Homo sapiens
  misc_feature (1148)..(1148): n is a, c, g, or t
cgcggccagaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagtctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttcctgactctaagaactgagtacttggtaacccctagttaggaaacgcgttaaggcgctaattgggggtaaacggctgaggagagccagtatttcctttggggctcntcttttcaggcttgagcttatgtcccgggttggcttctgcgagctatgcaaatgat

SEQ ID NO: 351703 - DNA, 256 bp, Homo sapiens
gcagccaagtaactttgagaaacactttatatcttaaatcattcttggagatttacattataaattagcatagtaaaggctcagagaagtctgcatcaagaaaaaaatcaatttagctttaaactcagcatttcccaagcatatttaaccatggaactttgtattcatgaaacacctgttaacactgcagaataactaggaatatggtttacagtttctaaatattataactcagaatattattattttggatgtg

SEQ ID NO: 351704 - DNA, 1793 bp, Homo sapiens
agctccgcaaggacccggacgcgaccaggggaggcagaaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaactcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctttttgcctcaaacactg

SEQ ID NO: 351705 - DNA, 2063 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctaaaaaaaaaaaaaaaaaaaaaaaaaaaaaaaaaaaaaaaaaaaaaaaaaaaaaaaaaaaaaaaaaaaaaaaaaaaaaaggggggggcgcgcgcgcaaaaataatattcccccccgggggggcccaccacacatgctcccggacaccaccacgcagtttttgttgtaaaacaagggcgtgccccccataaggtggtgcgttgttattattaatgaaggggaggggcggcggcgttataacaacaatgtgcgtaaggcggagacagaaaggcggagcgcacgcggagcacgacacttcgaggcgagaagggcaccccctactacctcgcgggggggggcggacaccccagcgggcggcgacacccaccccccctccgacagcagtatattaaacagcgccctctcatgggggagcaaatatgtacacacatatcatacagaggagagaatcctatgaagggggttcaacaacacaccagccccggcttacactctaggccgcgcggacgtaaaagaacaatgtcgcttccccacggcagacatgtcattatcgcactgccacactctttttcctagcagggag

SEQ ID NO: 351706 - DNA, 2335 bp, Homo sapiens
ccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatatatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagtgagtggctcccagtgccccgcaagcccctggccagccctccgggccccagggactgaaggctggctgtcccatcctcgctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351707 - DNA, 397 bp, Homo sapiens
ggatccccgggcagtacggatgtggggccagtacgatgtgccgtccctgggaggtctaggcgccacgaggtcccctctaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcggtgagatccgggtgtgcggg

SEQ ID NO: 351708 - DNA, 356 bp, Homo sapiens
  misc_feature (262)..(262): n is a, c, g, or t
ccagctagacttcctgggtgatgtggggacttggagaacttttctgtctagctagaggattgtaaacacaccaatcagcgctctgtgtctagctaaaggattgtaaatgcaccaatcagcagtctgtaaaaacgcaccaagcagcgctgtgtctactaaagcagcactgtgtctactaaagcagcgctgtgtctactaaacgcaccaatcagcactctgtaaaaacacaccactccgcactctgttaaatggaccaatcagnggaccttcttggtttgctccttggattccccttcccactccagcaccccagccagcctggtacgcagatcccagaataaagcaccttctcccta

SEQ ID NO: 351709 - DNA, 1721 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351710 - DNA, 1336 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcaggctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351711 - DNA, 1458 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351712 - DNA, 1220 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351713 - DNA, 2293 bp, Homo sapiens
ctttgcggggcgtggaccagcagggccccgcggggagggaaggagacgcggggcccggagctcggacctggagcccagccccgcggcccggaacggggcttcttgcctgtgcgtggcgtgactacgtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351714 - DNA, 1256 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgctgcactcctatgccacctccatccgtaaggctgtcctggcatccatggacaatgagaatggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351715 - DNA, 1949 bp, Homo sapiens
ccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatatatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcgagagcggtatctgcgtgtcgggacgtgcggaggctctcactttccgtcatggcgctgaaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351716 - DNA, 2138 bp, Homo sapiens
ccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatatatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggagtgggccatgctgcacagacaggggacctgcctgggcacagtggggacggtccgtttttccttccaacttggctttctgggttagacatcaaaccaaccgctggcatttggtctctgccaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351717 - DNA, 2707 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggtatggagctcctgggtccccgccttgtcctcagccagggggccctgaggactttgtgccaagaggggcattgcgcccagaagcactcggtgaggccatggcaagacgacctgtaagcccaggccttgcgtcccatggcctgtgatcccgccagactggcctgggctcggggaaggtggcaccagtcctgccacagtgtgcattgtggagttcaagcgtgtccccatcagtcagtgaaggtgggcccagtcccttctcagtcagagccaggtcagggcaggtagcaacaggagagaggtagcctgggcaggcttcctggaggaggtgcgggggggtctgggccagcctccctgaccctgccgtgcctcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351718 - DNA, 1853 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggtatggagctcctgggtccccgccttgtcctcagccagggggccctgaggactttgtgccaagaggggcattgcgcccagaagcactcggtgaggccatggcaagacgacctgtaagcccaggccttgcgtcccatggcctgtgatcccgccagactggcctgggctcggggaaggtggcaccagtcctgccacagtgtgcattgtggagttcaagcgtgtccccatcagtcagtgaaggtgggcccagtcccttctcagtcagagccaggtcagggcaggtagcaacaggagagaggtagcctgggcaggcttcctggaggaggtgcgggggggtctgggccagcctccctgaccctgccgtgcctcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351719 - DNA, 1471 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351720 - DNA, 1233 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351721 - DNA, 1031 bp, Homo sapiens
  misc_feature (872)..(872): n is a, c, g, or t
  misc_feature (879)..(879): n is a, c, g, or t
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatnaactggncgatgggcatcttgactccaccgcggcagggaggagcgcagaccgctaccctcagagaagccttcgagaaccagtgactctgatggacaacagacaccagcacactatggaagtaactcggaactacagcacgcgtgattgacattggtgag

SEQ ID NO: 351722 - DNA, 363 bp, Homo sapiens
tagcggtccgttttgggctgtcgtgcacacggctcgatgcgtgctggtcgaccatcatggcctggtggcaagccctggtgagccgctgcacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351723 - DNA, 250 bp, Homo sapiens
ccgcctcagcctctcaaagtgttgggattacaggcgtgagccgtcgtgcccagcccctgtgatttcttttacctccctctgagctgactcttgtggggccccacggctctgatttcagggcttgtctggctagagaggaccctcgtgcttggagactgggtggacgcctcctcgggcctgtttgcgctgcgatgctgggattcgagtgagagcagctgtgtgtgagcctgtccagtgacgggctccctga

SEQ ID NO: 351724 - DNA, 1483 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351725 - DNA, 1750 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgc

SEQ ID NO: 351726 - DNA, 1519 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351727 - DNA, 2337 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351728 - DNA, 2076 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351729 - DNA, 2383 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggagccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351730 - DNA, 2094 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351731 - DNA, 1762 bp, Homo sapiens
gaaattctcttgacgatgctgacttctcccaccttgctgctgaaaggacggcagtatatagtggctttccagaggctctgatggctccagcaactgggctcctgtaggctcttggtgaagacatgtgtgcctcctccctgacctcccctgtgtgtgtgcctgtgtgtgcgttggggtgggagtaggggacagtgaacggtgggtagctgggcagtgccttgccctgagactgaccgtcctgggtgtgagaacccttacagaggaaccccaggtcttgaatcccactgatttggacgccataggaaaacatgcagccaccattgacacatggtccaacagaaatatgccaaagacagaagcctcagcaggcataagatgtggggtgtggatgttctttctttccatggaaccatgaaagggtgatgggagagcgggaggcgtgtacatattgcatcctgcctcacacttggctcctttgattggtggcttcacagggaagtcagggcacaaggcagagcctttgcgacctcctgaaggaaggtgcctgcatctgtacagttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351732 - DNA, 1145 bp, Homo sapiens
  misc_feature (10)..(10): n is a, c, g, or t
cacaagcggnccggatgagatagcacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351733 - DNA, 2794 bp, Homo sapiens
cgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggtatggagctcctgggtccccgccttgtcctcagccagggggccctgaggactttgtgccaagaggggcattgcgcccagaagcactcggtgaggccatggcaagacgacctgtaagcccaggccttgcgtcccatggcctgtgatcccgccagactggcctgggctcggggaaggtggcaccagtcctgccacagtgtgcattgtggagttcaagcgtgtccccatcagtcagtgaaggtgggcccagtcccttctcagtcagagccaggtcagggcaggtagcaacaggagagaggtagcctgggcaggcttcctggaggaggtgcgggggggtctgggccagcctccctgaccctgccgtgcctcaggcacgcatgtgtaccagtggactttgaagaggtgcacgtgagttccaatgctgatgaagaggacattcgcaatgccatcatggccatccgccggaaccgcgtggccctgaaggggcttgtctggctagagaggaccctcgtgcttggagactgggtggacgcctcctcgggcctgtttgcgctgcgatgctgggattcgagcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctcccta

SEQ ID NO: 351734 - DNA, 944 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgtatgtcccctgacctctctgcgagcagtccagaagcagctgcagtggcctgcttgggcctgctctgagggat

SEQ ID NO: 351735 - DNA, 1686 bp, Homo sapiens
  misc_feature (1527)..(1527): n is a, c, g, or t
  misc_feature (1534)..(1534): n is a, c, g, or t
ccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatatatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggagtgggccatgctgcacagacaggggacctgcctgggcacagtggggacggtccgtttttccttccaacttggctttctgggttagacatcaaaccaaccgctggcatttggtctctgccaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatnaactggncgatgggcatcttgactccaccgcggcagggaggagcgcagaccgctaccctcagagaagccttcgagaaccagtgactctgatggacaacagacaccagcacactatggaagtaactcggaactacagcacgcgtgattgacattggtgag

SEQ ID NO: 351736 - DNA, 295 bp, Homo sapiens
ggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcc

SEQ ID NO: 351737 - DNA, 1095 bp, Homo sapiens
cgtaacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttct

SEQ ID NO: 351738 - DNA, 451 bp, Homo sapiens
gttttcataaatctaactaactcctatttgaaagagatgactgcatttatgcttggtggtcttcatgttacaatgaacatgtctttagtttcttatgatttgtatatgccacttgtttacaagatagcctagggttttccatctatttttttatccagaggacctcagcttacatctctctattaacatctatgcctaatgagagaaggttgcttccctgtgacttatacaaaatcagtgaccagctgtggcattaatggaagaggggccagaatgcatctcggtaatatatcagtgttctttttcttgtaacttagtttttaaatttctcgcccatgtatacctttcgagggatctccaaaagcccatgtatatactccttccaagtttctctcactgggccataggaccattaacgcatcaggaatggaaaatgaaggtagccataggc

SEQ ID NO: 351739 - DNA, 2715 bp, Homo sapiens
cgtaacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagaggacctcagcttacatctctctattaacatctatgcctaatgagagaaggttgcttccctgtgacttatacaaaatcagtgaccagctgtggcattaatggaagaggggccagaatgcatctcgtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgttcgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtg

SEQ ID NO: 351740 - DNA, 2590 bp, Homo sapiens
cgtaacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgttcgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtg

SEQ ID NO: 351741 - DNA, 3680 bp, Homo sapiens
cgtaacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgttcgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtgtccgtgtggttatgtcttctctcgttcacttactggcatagactgcagttctctgacaggcttgtttccagtcaggactctggccagcatgtccacgtggggtgcttcttctaagtgccttctctgcagagggttctggctagagagtcaaactgagaggcaactctctttaccctttatgcctgcctacctctgttgttagagatgagaatagagaccagctgtttccattgcaaatgtcactatttgaaaagaagttgttaatggaaatctctgcaagtatcgtactgtgtttagtctctcatggtagagatttcaaaagaagaaatgtatgtatcctaaatatgctgaaagcagtctgatgaaaggtttttaaatttcaggtgttaacttggtcaactctttgttaggaggttgtctgtactttaagtaaaattattctttggtttactggttattttggtttgctaaaattatgtcacttataattttgatttatatacaagagtgaagaattgaaggaaatactgaggagagacgtatgaactattttcttcatctcaattcctattttatcaaatgcaaaatgtaatcctaaccagttgattttctataattggtatcttagtactggggaggagtatcacatgaggaaagatttttcaaagcatgtcagctgaggcacaagaatcgcttgaacccaggaggtagaggttccagtgagccgagattgtgccactgcactccagcctgggcaacagagtgagacaccgtctcaaaaaaaacaaaaacaaaacaggtcaaaaatcagttgcacaagttgtatgaaaccaggtattctgcagctctgtctcttgtttattaagatatgcacagtttctgaatcaacaaatatatctgtgattcttttatactactacataaaagaacaggagtaattcttgccttataaattaaatgtcaaacatttcctatatgtaatcatttgttcctaaaatatgatttagtcccagcatgcttatccctgttttctctttttctctccagctcctatctagttcttcaacaaatcctgtcaactctaccttcc

SEQ ID NO: 351742 - DNA, 2659 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351743 - DNA, 2360 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgtta

SEQ ID NO: 351744 - DNA, 2799 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggtacagaatctaaggcaagatgcagggaagataaactaggataatgttttgggataaggtccatgggtgagtgtgggaggaataaactgtaagtcctagttttgggtccttgctttaacgccttacccaccccaggttctgttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351745 - DNA, 1641 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgatgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351746 - DNA, 2552 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351747 - DNA, 2253 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgtta

SEQ ID NO: 351748 - DNA, 2441 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351749 - DNA, 2783 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacaggtaaaggaagagaaagtgcaagctgttactaggatatccaacgaagagggtgggagacccttttacccagatcttccctcttctgaacagcaactccccccaactcatacactgccgttttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351750 - DNA, 2923 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggtacagaatctaaggcaagatgcagggaagataaactaggataatgttttgggataaggtccatgggtgagtgtgggaggaataaactgtaagtcctagttttgggtccttgctttaacgccttacccaccccaggttctgttctatgcgcaatagatggaaaccaaacagcagcaaggtactagggagatcccccctcaccatcctgcaggatgacaactcccctggcaccctgacactacgacaggtaaaggaagagaaagtgcaagctgttactaggatatccaacgaagagggtgggagacccttttacccagatcttccctcttctgaacagcaactccccccaactcatacactgccgttttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351751 - DNA, 2157 bp, Homo sapiens
gggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaactggtaacttcgggagttgagccacgagctgttgtgcatccagaggtggaattggggcccggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaattt

SEQ ID NO: 351752 - DNA, 3809 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacactatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaattttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaat

SEQ ID NO: 351753 - DNA, 2273 bp, Homo sapiens
gaccagacgaccagaccagaccagaccagaccagaccagaccagacgaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccagaccagaccagagaccagaccagaccagaccagaccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaattttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaat

SEQ ID NO: 351754 - DNA, 1298 bp, Homo sapiens
gcaaagagaggaggaggctttgggcaggggtgcttggagttattttccagagggaactttgactctgtctccggccttccctagggctgcagggtgcaaggactgactttgtgtgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaattttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaat

SEQ ID NO: 351755 - DNA, 941 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacactatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtttgttcgatcatgatacttctgataaggatcatcaacgtaccagtttcgcctcttccagaaggacgtcgtcattttatctaagagtttactctgggttttattgcagaatacaaattccctcaatcgcttct

SEQ ID NO: 351756 - DNA, 336 bp, Homo sapiens
accgggtctcatccttcaaaagggcagtgttgctgagaacctaacagaacttgtgttttcatctctctctccaggtttccattctattatgaactaaaaatagcatttgtagcctggctgctgtctccctacacaaaaggctccagcctcctgtacaggaagtttgtacatcccacactatcttcaaaagaaaaggtaatatatgctgccatgtctttcattctttctagcaagtgagaaaataagtaataaataaaaagggatgatcttattgcaggagacttctcatttggctctcatttgcctccagcaagtcattcctcctaatcgtttttt

SEQ ID NO: 351757 - DNA, 3863 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacactatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaattttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaat

SEQ ID NO: 351758 - DNA, 2738 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaaaaaaaaaaaaaaaaaaaaaaaacaaaaaaaaaaactctccgagaggcctttcttattcgcggggtcgtgcgcgagaaaaagaagggttgatagagaaagtgggcccagtgtggtcctataagcggtgttccctcggaccaccgtttttttcttgttcaaccaagggcgtcaaaaacgcggcgcgggtccacccctaatagggaggagcccgaataactaactctcccgcaaaaaacccgcgggtctacaccccggcatcttaacggaacccgcgggaacaaagggcaaacacagccaccacaccagacaccaacgccaacacaaaccacaacacccgccacccgcaacgccggcgccaagagacaccgacacaccggcagcaacaaccacacacacagcccagcagacgagccagaacagagcagcacgacaaggcagctagccacacacagacaccaaccgcccccgagccccacgagacaccacacacggcaccgacggcgcaccgcgcagcacacaacagacacaagcccatccccggagcggaacgacacgtgagagcgggagggcagacgaggagagacgagggaaaagcacggggggcggcgacaggacgaggcgggcacgaggggcgggagagggaggcgcgccgaccaccgaagacggcgggcgaggaaagcg

SEQ ID NO: 351759 - DNA, 2065 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtcctgaccatttattggggactttttgctcagcactgtaggaggaaagaaggaaggagggatggaagcctcttcctctgcttctcctgtccctagaaccgtaaagcccagacgtcctgcttcccactgggaccctcaatgataacagggtcagtgactgactctgaggcagcaaggacagaggtcgagc

SEQ ID NO: 351760 - DNA, 1933 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351761 - DNA, 2627 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggtactgtgaagagttgatgtcctatccagggttgggggtgggcagggaggataccctgccagtcacgattctactattgtaacagaaaacaactcaaacaggtttaaggggaaaaaaaaaataggctctattgatgcatgaaactaaaactggcttcaggtgcggctggatccaggtgctggctccatatttggtcctacgttcctcccattcccaggccagctttctctccttgtgtaagtaggaggcaaagtcaagcacgctttcctgatagttccagttaaagtcctggggctgattctcatgagttcagctgacatcaggtgcctgtctctgagccagtcattgtggccaaggcaatagaacgttctagttggccaggcctgattcttttccccacaaacctgccatgtggtggtaagggaagttctgcgaagacgttcaggatcctgggcctggagaagaggcatgaatgtccaccacaggggctctgccggtcaggatcaaggtcacactggatgagggagtcctgaccctctcccgggctgagcccacctgtgctgcccccaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351762 - DNA, 1297 bp, Homo sapiens
ctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagttaaaaaaaaaaaaaaggggcggcgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351763 - DNA, 358 bp, Homo sapiens
aaacagaaacacagagttgcagagggacccagctaggcactgacagagcaggagactaagatcctctggccttgtttgacctttcaccattttttctcttccccaccctcgactttgtcaacctaatcacccaccctgtctcttttctaccaggcaaaccaggacagtggtgaagtgcagcaggtactgtgaagagttgatgtcctatccagggttgggggtgggcagggaggataccctgccagtcacgattctactattgtaacagaaaacaactcaaacaggtttaaggggaaaaaaaaaataggctctattgatgcatgaaactaaaactggcttcaggtgcggctggatccag

SEQ ID NO: 351764 - DNA, 2057 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351765 - DNA, 2917 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaaaaaaaaaaaaaaaaaaaaaaaacaaaaaaaaccccggggcgccctctattattgcgcgggggcgcgggacaaaaggggtgtaagaaatgggcgccctgtggcgccaaaaacgcgtgtgtctcccgtggccccaagtttctccttgtgtgcaccaaggggggggaaaaatccgcgcgcgcgggtgtccccccctataagaggaggggcgcgggatataaaaaattcgccgagataacaccccgagtgtgtgacaccccgcgcgcgtttatataggtattcgggcgagcggaaaagaaccccccaacacgcaaaccaagacccccggcggcgccaacaaaggagagagcaaccgcgcgcgccccgaccaccacccgccgcggaacgcgggcgcgcacacagcgcgacaacactagtgcgggcagaccacaacacacaccaacgagtaggagcacccaggcgggagacaaacacacgcgcaggaaccaaacaggagggacacaaacaacacaaaaacagacacaaccagcgaatgaacaacgcccaacacacccgaagcgcaaacaaaagacaaacaggacacgcgcgaatacaacaccgaacatgcaacccacacagcaatcttattataccccggacaagggggacaaacgagaggagcaagaggcaggcggaagaggcgacggagcacaaagaagccagcaccgcgaacagagggagcaggacgacggcagacgaaagagagagaagaggcgagcggagcgataagaagaggaggggaggaccaagcacaaaaacgaagagcgaaagcacggcggcggcgacgacgaccgggccggccggaagcaaaaggaacgcgcaag

SEQ ID NO: 351766 - DNA, 2187 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaggcccgcacagcctcctgcccgcgtgccctcgcccgcagcctctgccgccctagacccacccaccttggctcctccccgggctcagcttggggtgggcgccagttccgagcatggctgtctcacaggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351767 - DNA, 2614 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaaaaaaaaaaaaaaaaaaaaaaaacaaaaaaaaaaactctccgagaggcctttcttattcgcggggtcgtgcgcgagaaaaagaagggttgatagagaaagtgggcccagtgtggtcctataagcggtgttccctcggaccaccgtttttttcttgttcaaccaagggcgtcaaaaacgcggcgcgggtccacccctaatagggaggagcccgaataactaactctcccgcaaaaaacccgcgggtctacaccccggcatcttaacggaacccgcgggaacaaagggcaaacacagccaccacaccagacaccaacgccaacacaaaccacaacacccgccacccgcaacgccggcgccaagagacaccgacacaccggcagcaacaaccacacacacagcccagcagacgagccagaacagagcagcacgacaaggcagctagccacacacagacaccaaccgcccccgagccccacgagacaccacacacggcaccgacggcgcaccgcgcagcacacaacagacacaagcccatccccggagcggaacgacacgtgagagcgggagggcagacgaggagagacgagggaaaagcacggggggcggcgacaggacgaggcgggcacgaggggcgggagagggaggcgcgccgaccaccgaagacggcgggcgaggaaagcg

SEQ ID NO: 351768 - DNA, 1988 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctgatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351769 - DNA, 890 bp, Homo sapiens
ccaagagctcagagcctcctgactcctgtgccctctgtcccaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 351770 - DNA, 347 bp, Homo sapiens
tcaataccaagcaggaagagggggcagggagagagagcatgagtggtagtctgtccttccacaagctgctgacagatggaaattaaagtggtctggggagagacattgggggaggaggcagtggcggcagcagaagtacagcaaggcagcagaattgggagcagccctggctgggggccaaagccagctcaccctgacagccagcttaaaatcagggagaatttggagggagggggtggcaacagcaccccacccagactacagaggccaggcccaaagcctctccctggggtggggcaaaagaaggctaagggcaggccccatgagctaaagagatgtgaaatgcc

SEQ ID NO: 351771 - DNA, 1291 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcaggtaagtaagtggctttttagagtgattgccttttcccctcaaagagcctaattttctgtactaaatgctgcaattcgattatatttagtctttgtattattgttacttaatttctttcatctctaataatggtcaccatatgatttttcctttcaggcatgttatatcaccattaagaaagaaaaatacctggcaacggtggctcacacctgtaagcccagcactttgggaagctgaggcgggaggattgcttatctcaggagtttgagaccagcctgagcagcatacctcgtctctactaaaaattta

SEQ ID NO: 351772 - DNA, 6360 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagaccttggtaaaagaactattttggaaacagtatttgtaaatggaactaatgctatatttaaaaacactgatttttttttaacctgccaaaaataaaaaaaagctcattttataattttctactaaatttgagttgattatctggaggtctcatttcttgtaaagtataactttttcagaaactaccaccaaattatccaactgttatactaccagaaggctttaaaaagttaaaaacctaatatcaaactttctaggtgttaagatataaggcattgcctgactctagccccttaattataaaaactttaacatatctgagaggagccaactatggacgtttaactcatctttcaaaaattctcccaaccaagtctttgaaaaaagaaaacaaatacaggaatctagaatgagaacaactaggagtggcccgaggctgggcagcatctgaaaagcaaggcctccgtcttcctttactttagtgcaggggtgtctaatcttttaggtcctagccacattggaagaactgtcttgtgccacacataaaatacaccaccactaatgatagctaatgag

SEQ ID NO: 351773 - DNA, 4365 bp, Homo sapiens
catacagtatttccatcttgacagagtctctgaaggactaggtcagggtaattaactatcattgatttaacaaggtagattacttttcagcaacaagttcattcaaattttctcctgtttagataatgcagctgactttattaggggcaaatattatgtatggaggggaaaacaattttttcctaaattaaaggtgagtgaaggagtgtggagaaagaacaaaaatgagccaaaaagaaaattcaagagtaaatacatataaatttcagtctgtggacaactccctaataaagctgtcagtttgcttcattcgttcctcttctttttttcttaataggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagaccttggtaaaagaactattttggaaacagtatttgtaaatggaactaatgctatatttaaaaacactgatttttttttaacctgccaaaaataaaaaaaagctcattttataattttctactaaatttgagttgattatctggaggtctcatttcttgtaaagtataactttttcagaaactaccaccaaattatccaactgttatactaccagaaggctttaaaaagttaaaaacctaatatcaaactttctaggtgttaagatataaggcattgcctgactctagccccttaattataaaaactttaacatatctgagaggagccaactatggacgtttaactcatctttcaaaaattctcccaaccaagtctttgaaaaaagaaaacaaatacaggaatctagaatgagaacaactaggagtggcccgaggctgggcagcatctgaaaagcaaggcctccgtcttcctttactttagtgcaggggtgtctaatcttttaggtcctagccacattggaagaactgtcttgtgccacacataaaatacaccaccactaatgatagctaatgag

SEQ ID NO: 351774 - DNA, 4565 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacggggtattctcatttcggatctgggactcttttcttcccccccaggtcaatggggggggccacccaatttttgccgccgatgcg

SEQ ID NO: 351775 - DNA, 2445 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctggtcagtaatcaaatacatttgaatatgctagtaagactttgttatgagtttcattctgtgcattttttaaatcaaaatgatgatgagatacatattaagacattatatacaccacagcaatttgtaaaagatgcactggaattatagttaaatttgtaaggaatttttaacaggcagaatatttaatgtattgtctttacaaactggtagagcagtcaatattcaaaaaggatctgggattgttccacaataaaaaataattaactcgaaacacagtggagccacaaatagagatagaaggaactaagacttcatctaaaaagtcatcttattaccaaagataggaaggaagcatgtttgattttatgtagactttaacttagtgtaaatgtgcaacgtttttttttagatccagcaaagacgaggaatgatgacattctagtagaaagacaatagatttgaagaatcagcgtagtgtaataactaagaacacagactttggagctagactgcctaagtctctgtaacttactataaaactatatgaacttgggaaagttacttagtttctttatgcttttgtttccttgtgta

SEQ ID NO: 351776 - DNA, 772 bp, Homo sapiens
aaaatctacacaaacttacaaattttaaatattttttagtccatcaacaagcaataatattccgctaatgagggttgtacaatccatcaagcacacaaagaggaagagcagcacaatggtgaaggaagggtggatggtccattacaccagcagggataacctggtcagtaatcaaatacatttgaatatgctagtaagactttgttatgagtttcattctgtgcattttttaaatcaaaatgatgatgagatacatattaagacattatatacaccacagcaatttgtaaaagatgcactggaattatagttaaatttgtaaggaatttttaacaggcagaatatttaatgtattgtctttacaaactggtagagcagtcaatattcaaaaaggatctgggattgttccacaataaaaaataattaactcgaaacacagtggagccacaaatagagatagaaggaactaagacttcatctaaaaagtcatcttattaccaaagataggaaggaagcatgtttgattttatgtagactttaacttagtgtaaatgtgcaacgtttttttttagatccagcaaagacgaggaatgatgacattctagtagaaagacaatagatttgaagaatcagcgtagtgtaataactaagaacacagactttggagctagactgcctaagtctctgtaacttactataaaactatatgaacttgggaaagttacttagtttctttatgcttttgtttccttgtgtaaaattggcataataa

SEQ ID NO: 351777 - DNA, 6307 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagaccttggtaaaagaactattttggaaacagtatttgtaaatggaactaatgctatatttaaaaacactgatttttttttaacctgccaaaaataaaaaaaagctcattttataattttctactaaatttgagttgattatctggaggtctcatttcttgtaaagtataactttttcagaaactaccaccaaattatccaactgttatactaccagaaggctttaaaaagttaaaaacctaatatcaaactttctaggtgttaagatataaggcattgcctgactctagccccttaattataaaaactttaacatatctgagaggagccaactatggacgtttaactcatctttcaaaaattctcccaaccaagtctttgaaaaaagaaaacaaatacaggaatctagaatgagaacaactaggagtggcccgaggctgggcagcatctgaaaagcaaggcctccgtcttcctttactttagtgcaggggtgtctaatcttttaggtcctagccacattggaagaactgtcttgtgccacacataaaatacaccaccactaatgatagctaatgag

SEQ ID NO: 351778 - DNA, 5023 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtggcttatttcttcatttctcagtaatcattgtaaatcttttttttttttcttctccactctaacaaaagtaaaagaacaaaacttttgctgaggtcttggactccactacttgttagttatgtt

SEQ ID NO: 351779 - DNA, 2553 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggtaagcaactacagccgtttgcatattgtacacattattttaaaaactggaaaatgtaaaacatctgccagctgttttgtcatctcatagttttgtccagtgccttttttttaaaggctgacttgttatctttcagctaaatccttctcactgtaatttgagtattcttcccttaatgtcattgcaaactttaaaaattaacagaatcagaaaattttaca

SEQ ID NO: 351780 - DNA, 697 bp, Homo sapiens
ggtgtcctcatccttccatcctcacaacaaggcacaggcaggcagcacgtggggccagttcatagccgggaccaccccaagctcttggggaggtgcctcagccaccccagtgtagattctgatccaagttggaggtgtagggcctggaggtccagagtgggaaggagggccttccccaagtccttagagtcacacaggcagggaacaggcaggagatggtggcttttcaggttttcagagtctcacttgatccctattttgctggtcttgagattaggaatctctgtaaacctgctgattgttaatttagccgtatgttcactgcctaaggagtcagctctgttcagattctcagttgaatcgtttttatctatacgtgattgttattaagacatcgggtaaatataggcctggcgcggtggctcacacctgtaatcccagcactttgggaggccaaggcgggtggatcacgaggtcacaagattgagaccatcctggccaatatggtgaaaccccgtctctactgaaaatacaaaaattagctggatgtggcggcatgcgcctatagtcccagctactcgggaggctgaggcagaggatttgcttcaacccaggaagcagaggttgcagtgagctgagattgcatcattgcactccagcctgggagacagggcgagactccgtctcaaaaaaaaaa

SEQ ID NO: 351781 - DNA, 1159 bp, Homo sapiens
  misc_feature (42)..(44): n is a, c, g, or t
gcggccgcctactactactactactactactactactactgnnngaattcaagcttctaacgatgtacggggacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351782 - DNA, 2546 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagta

SEQ ID NO: 351783 - DNA, 889 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaaggtaaaatcttaagtaaatatgagtttttatgacaatctatttttgtctcagaagacatggtttaaagagttagacgaaattacttttgtgggtcttatgaattatttctttccacacacttgtagtcatttgcttcgtgtaagatcagatttttgagagcacatgtattaagtgttagaatgtttcaatttgaaattagagca

SEQ ID NO: 351784 - DNA, 4214 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351785 - DNA, 4205 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacagtaattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351786 - DNA, 4224 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagagtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351787 - DNA, 2556 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtgataaatctgttcagataagctccttatgaatccttcagatcgatgttcttgaggaaaacagtcaagctaaacagcaatgatgacttttatggtaaaggatgagctgatcactagctaagctacttagtcaccatcctgggagatgagctcacaggcaccaaggctttgcttcctgtggcctgctagttacagtgaaccagctccatggattgacaagggtacacaggatgacagcagagcaaaggagtttgccaagtatttgttctgtcattaagtattcaaaagaacatatatttttcttcatggaacataactttctaagaatgaaatttggggacttgaatgattcaaggtcaaatattaaacattagctccttcaccaatacctgtcattgtcattagaaaggaaggcctcttgtttacgctactgtgattcacagtgtcctttgtcggtcaagaggccccctctgtggcttggctttagctgtcagatggaagcctcaaacttttgcactttaggtcatctagtgtcttccagtgtttgtagttgtcagccaaatgttgcatcagggctggcagatgtgcaaaggcatcccaagcatcaaacatctctttcattgactacttcataacagacatgtttgatgttggagcggccg

SEQ ID NO: 351788 - DNA, 2279 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtgataaatctgttcagataagctccttatgaatccttcagatcgatgttcttgaggaaaacagtcaagctaaacagcaatgatgacttttatggtaaaggatgagctgatcactagctaagctacttagtcaccatcctgggagatgagctcacaggcaccaaggctttgcttcctgtggcctgctagttacagtgaaccagctccatggattgacaagggtacacaggatgacagcagagcaaaggagtttgccaagtatttgttctgtcattaagtattcaaaagaacatatatttttcttcatggaacataactttctaagaatgaaatttggggacttgaatgattcaaggtcaaatattaaacattagctccttcacca

SEQ ID NO: 351789 - DNA, 1219 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggcaatgac

SEQ ID NO: 351790 - DNA, 2024 bp, Homo sapiens
  misc_feature (42)..(44): n is a, c, g, or t
gcggccgcctactactactactactactactactactactgnnngaattcaagcttctaacgatgtacggggaccatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351791 - DNA, 550 bp, Homo sapiens
aaaatcaactcatcttgacagcctctgctgatagaacagttattgtatcctttaatctggaagaaatgaacaagctgtagtggcctaaggagccactacatacactattagtctttagctgatagggtcttgtctgtatattcttgttatagcaaaaatgatttttgttctgttacttataagataccatttattaggtatctgaaaagtattagactggaaataggaggttaaggcttgttattgatggaaactccgtgactattgctgttctttccagagttactctatcaggttgtataaaattgatgaaatgggaaaatgtggacttaaaaataatttattttactatctcagtttgcttttcaatttagggaaacaacgatgagttggactggagaataatttacattttttttccccactatacagcagaagaaaccaaatggtcccaacccataaaaatctttggagcatctgagtctgatagaaaagtgaattactgtttgttcagtgtgtaatatttaataattaaaaacaattttataaa

SEQ ID NO: 351792 - DNA, 236 bp, Homo sapiens
tagacattccattcagttatatctttacatagataaaatgatcgataatgaggcatatgtgaactttgcctagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattca

SEQ ID NO: 351793 - DNA, 468 bp, Homo sapiens
ctgcaaagacagaaaagaatcaaaagaaaccggtgaacttagaccccaggagcatttataagcctgggggtgtctgggacaagtttgggatcagaattagaggaggcacaccctgggcgaagcatgaggacaagtcattaaacactagtttctgaaatgcaaacaggtcctttttgaaaagctgcttatcagtgacattatcagaagaacctgtgattcagagtaaactaaatacattttgcattctttctagagttttcctccaacgacagaaaaacactgcagtaagctttggcagcgtgtcctttgaagaggcagagactcgtttatccagctatcaaaaatccatcaagtcttctgcacacaagcttctgtgccagctgctggggatgcaaagaatgcaccccaccccacttggccacaaaaagctgacagccacatttttaaaaatatattttgtttaccttt

SEQ ID NO: 351794 - DNA, 423 bp, Homo sapiens
ctgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctac

SEQ ID NO: 351795 - DNA, 1697 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatca

SEQ ID NO: 351796 - DNA, 4268 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351797 - DNA, 4282 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtgataaatctgttcagataagctccttatgaatccttcagatcgatgttcttgaggaaaacagtcaagctaaacagcaatgatgacttttatggtaaaggatgagctgatcactagctaagctacttagtcaccatcctgggagatgagctcacaggcaccaaggctttgcttcctgtggcctgctagttacagtgaaccagctccatggattgacaagggtacacaggatgacagcagagcaaaggagtttgccaagtatttgttctgtcattaagtattcaaaagaacatatatttttcttcatggaacataactttctaagaatgaaatttggggacttgaatgattcaaggtcaaatattaaacattagctccttcaccaatacctgtcattgtcattagaaaggaaggcctcttgtttacgctactgtgattcacagtgtcctttgtcggtcaagaggccccctctgtggcttggctttagctgtcagatggaagcctcaaacttttgcactttaggtcatctagtgtcttccagtgtttgtagttgtcagccaaatgttgcatcagggctggcagatgtgcaaaggcatcccaagcatcaaacatgtctgttatgaagtagtcaatgaaagagatctgagacttggggatgctacaggtattccggtcaaacactggcatcaccacaggtagtccctgtctcttctcttcatcagtctgtgcaaaatactcctcagagatcctcccagcccattcaatgcacaggtccaaggggcggcatgggttggccacgtcagcacacttaatcatcatgcgtttgatcaggatttggttttcagggaagttcttcccagcagggttgcattcacagtcgctgccttcaatctcagctgccattggcttgttgatgctgttcacaaacttattcacatgttcaaagtgttttgtcatctctgttgccaaaaccatgtcaataatagcctggcgcagcgttcgataatggttcctgtcaatattcttgaaaatgttgcatttggtgtccttgaccgtgagctggaaggccagggcggtgtggtgactctccagaacagcagtgtcattgtagagcacagcaagctcactgcctgcattgcagaggaaagagttggtccttcccgggtgatccacgtcatggactgtggcagcaatgagggctgccacctcatccaactgatcgaggcttccctttactctttcctttccaagaaagaaagcggtggcgtgcaggacgtcggcagcatgggtggagttgtggtaggcattggaagagtggtagttggcttcgatcacttggaaccaggcccgaagagtggtttcagaacagtttaaaaactcacatactccaaaccgagagaagacctttaagcccagataaaccaatggccttttatgcgtaatggcttccaattcaaagatgttgaagtcccaactctcctcattatcaagtaattgagagatacaagggggaacatcattgatggttattggcattgcaaggtgactgtgactctggtgcacattcttagtaaacacatactcgtttcctgacagtcttctcaagccgtcagtcatcaggcctccaacaagatcactggtgtggggatcttcatctttggtacccagctgaggggagtacagttctgtggtccgtaaaatctctagaactctgtccaaggcttccgctactgtgactgggctgttttcttgggctgcattgattatatttataacctttgtgatgggagcctcgatggtcatggagtggatcctcgccatggacggatagcgacgattctgcaggcttggtgcatcactgcctcgagatgatatcgatttcacgtcaatggactctttcctcctgttcttatatctgaatgaatgaggctctgtctgagaattgtctcctgaatcacgatgaatcttgtgaatctgcttattattgtcagtggtacaacacagtttcttgagcgagacaaaatgcctaattttccctccttggccaatcactggggtgatcttcacgtgctgttggatgctgtccccggatttccgtctggcatagtaaaccccctgccactcctttcccttcttgatgcatgtattgatggtgtcgagaaggtctgcccggttcttatcgcttttgggcagatcagcgagttcttttcccaggagctcacctttgtggtagcccatcatcctttcgaaggctgggttgacatactgaatcacgtggtcatcgcttgttatttctatggcttcatgacagtgatctaatgctgtaaacactgaattacaggcccgtaatttgaactgggagcgaacttccccatgttctatttgaat

SEQ ID NO: 351798 - DNA, 4224 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351799 - DNA, 3644 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaatagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaataaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattcattcacatcttcaggctccacttcttccagactccttttaatgctggaattttgaccgcctcccatgaatcagaatgttcttagtggcatctagaatgctaaatgcttcccagaaggttttcaattgactttgcccagactcttcagaggaatcactagttagggcagctacagccttattaaatgtatttcttaaataaataagacttaaaagtcaaagtgactccttgacccatggactgcagcatagatgttgtggtagctggcacgaagacaacatgaacctccttgtacatctccatcagaactcttaggtgaccaggtaacattgtaatgggcagtaatatttggaaagaaatttgagcaggtctcaaccataggcttaaatattcaataaaccatgctataaaca

SEQ ID NO: 351800 - DNA, 2220 bp, Homo sapiens
gcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacattgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtgataaatctgttcagataagctccttatgaatccttcagatcgatgttcttgaggaaaacagtcaagctaaacagcaatgatgacttttatgagttttcctccaacgacagaaaaacactgcagtaagctttggcagcgtgtcctttgaagaggcagagactcgtttatccagctatcaaaaatccatcaagtcttctgcacacaagcttctgtgccagctgctggggatgcaaagaatgcaccccaccccacttggccacaaaaagctgacagccacatttttaaaaatatattttgtttacctttaggctcaccctgtgtca

SEQ ID NO: 351801 - DNA, 476 bp, Homo sapiens
tcagtggtgaactgactgttggcctggcagatgagaagttttactcccccactctccagtgaaactggtgaaaagtatttttaaaggaattaagaatgggtcaatgaaatatacagctcctttctggaatgtacctgttctgctacaaccatggatatcctgacctttctgtgcctttcagggacaagggtaatagaggagtttcagactccctctaaaacaaaacaacaactgaacaataaacaacagaaaaagaacacaaaaaaagacggtggtactctttcccctttccttgctttctcctgctaccaaaacaaacaacaaaaactacattgtctcattggatgacgaagctaaaattttgtagcaaatctatagaagaaaagaagtggaaatctactcaagagctactgtaaaacactgtatacaaaacaaccactttgattcacattaaaaagtgttatctgtttctttga

SEQ ID NO: 351802 - DNA, 876 bp, Homo sapiens
gaattgtaatgaactcttgttgcgttcacttctttgcataactcgttattgcctgtacaaacaaattaagcaggaagaggaagaacctccacaatgacattagcctttcctggcctgttttcagtagttgatactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctgacataagcaaaacggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctaagcaatatagtgagaccccatcactattttttttttttggagacagaatatcactctttcacccaggctggagtgcagtggcagcatcttggcttactgcaacctcttcctcctgggttcaagcgatcctcgtgcctcagcct

SEQ ID NO: 351803 - DNA, 1149 bp, Homo sapiens
gaattgtaatgaactcttgttgcgttcacttctttgcataactcgttattgcctgtacaaacaaattaagcaggaagaggaagaacctccacaatgacattagcctttcctggcctgttttcagtagttgatactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctgacataagcaaaacggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctgggtgacagaggaggctctgtcctaaaaaaagaagaaaaaaatatgcttttagaggattgtttccaatgtcctgaattaatcatgttactgaatactgcagaatatatgttctttgtcttgcctcttgccttgacgcctcttttccctacttgccgtctttctaaaactgtgcccataattggaaatttgttgttgttttctatctagacttcgagataactctgttgtttgcctggaggctgcttcagcaatacttttgtacaaaaggaatgacctctttacatactgatttcgtttagcttatcttgttatttctattcatgcacccattcccacaaaacacacagacacacacacacacacacacgtgcgcacgtgcactccctccactcatctatgaattcctcatgatattg

SEQ ID NO: 351804 - DNA, 768 bp, Homo sapiens
ccaggctaatttttctgcgtttagtagagatggagtttcaccatgttgaccaggctggtctcaaactcctgacctcaagtaatccaccgcctcgacctcccaaagtgctgggattacaggcatgagccactggccccggctggccccatcactattaaaaaaataaaactcttgagagtaaccagcaactttcttcctaacattttctcctcaaaaataccctttcattagctgagcatggtggcacgcacctgtagccctggcttctcgggagactgaagcgggaggatcattttagcccaggagttctaggctgcagtgggccactatcacggtattgcactccagcctgggtgacagaggaggctctgtcctaaaaaaagaagaaaaaaatatgcttttagaggattgtttccaatgtcctgaattaatcatgttactgaatactgcagaatatatgttctttgtcttgcctcttgccttgacgcctcttttccctacttgccgtctttctaaaactgtgcccataattggaaatttgttgttgttttctatctagacttcgagataactctgttgtttgcctggaggctgcttcagcaatacttttgtacaaaaggaatgacctctttacatactgatttcgtttagcttatcttgttatttctattcatgcacccattcccacaaaacacacagacacacacacacacacacacgtgcgcacgtgcactccctccactcatctatgaattcctcatgatattg

SEQ ID NO: 351805 - DNA, 791 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggcactatcatgggaccacaaaaagcaatatgactctccttgtcctggagcggcttacaattgagtggggaaaatgagaagtataaataaagaatttcaacatag

SEQ ID NO: 351806 - DNA, 5652 bp, Homo sapiens
cgtccaccgtggagtctctccttgctttgggtccactgagccccacacattgttgagtgtctgattgtctccttgcccttacaggacaggaaagcgaaatctctgttcctttgtagggacctttcttttgtaggtgaaagggacagaaatatgattctggcctccttgatggtgaatacaggaacactttcagataaattacaatagagaggagtcagcttatttaaacaaactgaggttaagccagagattgcagttaacagtgaaaaaatttaaagcaagtacctggatggatgcaaagcagtgcccaggagacccaacttacgtgacagagatgatcattgtcactcattcattatgttttgagcaccagccatgtgccaggtccagaactagaagaaacttgggtgtaggtgagatcataggaacagtccctgccccagctgaacatcaggaagccagactgggagcacatgccgtggctgactaggactccagcagggacctggggttccatcagatcagtgtaaagcgatggtttcccaaatgagacctctccagagatggttcattccaccccgcaatggccaccagaaacattgtgctgaccagagggcttcactgccccaaaccccaaaatcacactccaggatgagaaacctaaaagtctatcttgatgaggcttcatagctggaaaccacccctcatggatccacaggctgcatttgatgaaaggagactccaggaagtcgagccattccaggcagacatgtagcaaaagcccgagctggggtccgccctcatgcaataaataacacctgtgcacataagagaggtgacaggcagggcatccctggggacctgggcctgtggcacgtgaagaaacacccaagagagcacgaagtcccaatgccatgaccagatatttcggtgccaggcatgcttctgggtcccagcaaaagacacacaaatccgtgtccttggggacccacagtctagtgacctagggctggccgggtcgcacgcttcttttcaagggctcgaaagcctctgcatggatgcaactttgggggaaaagtaaccctaaccctctgcttctctcatcctcccctcttctgtgtatatgtctgtctctttctctctgtgtgtgcccttccccactcccatccccattcctttttttatttattatattttggtggtgtgtggctcggtttctgttggtcccctcgtgtggcccctcccctgctgcagaactcgtccagctcggcctcctccgaagcctcggaaacctgccagtcagtgagcgagtgcagctcccccacctctgtcagctcgggctccaccatgggtgcctgggtgtccacagagaaggtgaccgcccgggtggcagccacagcggccccactctccctggtccccctgcctgctgctcagacagccctcacagccgcggcaacctggaagctcagaatcgacaccaagagtggggctcctcttggggacagagggtgggacaaggctgagagcattttctagaatgagtgcctggctgctggacaatgaccacatggttgtctcaagggagaggaaggggtatggggaatttggaggtgtgaaggctttctcccagaccaggtgttgcgtgcctgtccatcctcctccctcccttcccgagccacccaccagaccgttggatgagccatgtcactgtgtcagaggctgtgtgcttttccgctttttagtttgcacccccacccccctgcccttgattgagaatgtgctcctgagcaatgcgacgattttggaaacctagaatgaacagattcatttgaagatgctttggaatttttaaatttgcataatgaaatgagcaaatcactatcaccattaaatgaggcttcattagttacattatcaaaaaccattgacaaggccacaaattgagggcactgatcaatttccaaacttctaaaacgtaggtcaaacatagatgcttatttgctgtcaaactcatgtgcattctttgcaccccggctcttttctcttgcatcacagatcatccgtgagcagcagagccccaatgtttgttttatttataaatattcaggtttcccctcccttgaatgtcaatgccattttgtatctccgcactcatcctgttatattaattttttttcctttcccccccctttttttgtttgtttccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351807 - DNA, 4955 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351808 - DNA, 1123 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtaagcagatggaggctgactcccagtgttaactgcattctgcacgtggactcttccccttgggtggctgcacaagaagatgcagcttaagttatcagagctgagctgactcgtattttcccattttttaaaactctgtgggattccacatattagaagttgcaactagttttctggataataaagcacatgtgaagaagaatgaaaaaggaagaaaatgaaccactgtttctgcacgagttggcttgatgggttctttgatcactttaatgacgtgctggttgttgaaccttgagctgtgcctttggttgcaatttgcgttttcctccttacgtgggttttccttgtttccttgtggaatgggaagcagtagggatgattggatagaccatttttctgagtttccataaaatgaagaacccttttaaaataagga

SEQ ID NO: 351809 - DNA, 4901 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351810 - DNA, 5067 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaaaaaaaaaacacaacgaaaaaaaagcaaacggaaaaaagaaacaagaaaaaagaaaaaggggggggcgcaaaataacaccgggggaggcatcaaagggtattgagaggcccaa

SEQ ID NO: 351811 - DNA, 4046 bp, Homo sapiens
agcggggtgtgggtcgtgcattgtgtgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351812 - DNA, 3886 bp, Homo sapiens
atacatcatcggttcctggcgtaggcctagaactagagcacacgtctacaggacgctagccggtagaccccaccctctgctccctgtgccctgcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351813 - DNA, 4456 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaataagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351814 - DNA, 3720 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgaggctagtgggctgatgaggctagtgcgctg

SEQ ID NO: 351815 - DNA, 2847 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtag

SEQ ID NO: 351816 - DNA, 261 bp, Homo sapiens
tgttggggactgctcccaggcacatgaaagtttctccgaaccacctgatgggtaccttcagtgcaatgatactcattcatcacaggtgcttaaaagtatttgaatgaatttgcagcaagaacccttctcattcattgaacaaactccttttatttcaggcactatcatgggaccacaaaaagcaatatgactctccttgtcctggagcggcttacaattgagtggggaaaatgagaagtataaataaagaatttcaacata

SEQ ID NO: 351817 - DNA, 539 bp, Homo sapiens
ctggggaagagccccagtcactctggttccctgcttggtgttgtttggggcaagtgggagaacagccagggccatgtttcatgaacaagtggttcagggtggagctttaaatgttctgtacaccttaaatttggacccaccatctaccaactcaaaagtgtatgtgtcagattctgccaaactagttcagttgatgtttgtagtatttacaagattataggaactgagcacattctaaactgattcctgagccaatacatgtatatagaatccgggaaacgtattgcagacctgcaaaggaagagaacatacacagattgttccctgcatgattggaattgggtgctctgttaatgtagtaatcagatgtctatcgcagtgtgacttactgatgtctttgatgtgttgcaggggagctatccagtttgggaagatttcataaacaaagcaggaaagctgcagtcccagcttcggtaagtagaagcacatgttctacaggaaaaggacaacatcctcagacaaggatggagtgggacaga

SEQ ID NO: 351818 - DNA, 417 bp, Homo sapiens
tgggtcgtgcattgtgtgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgtaagttaatggaaaactccagaaggtttaaactgctggtgtagaggtggcttccttctaattttatccatccactgttgagtcatggagaatctactgtcaggaatcatgatggtggtatctcctgtacagaccagcgattcagtgcaagttgatggccatgtagctcactcctcattcactgttctagtaccacttgttccccgttactttgtctcaccaagtcaagaaggcccag

SEQ ID NO: 351819 - DNA, 1782 bp, Homo sapiens
cgtccaccgtggagtctctccttgctttgggtccactgagccccacacattgttgagtgtctgattgtctccttgcccttacaggacaggaaagcgaaatctctgttcctttgtagggacctttcttttgtaggtgaaagggacagaaatatgattctggcctccttgatggtgaatacaggaacactttcagataaattacaatagagaggagtcagcttatttaaacaaactgaggttaagccagagattgcagttaacagtgaaaaaatttaaagcaagtacctggatggatgcaaagcagtgcccaggagacccaacttacgtgacagagatgatcattgtcactcattcattatgttttgagcaccagccatgtgccaggtccagaactagaagaaacttgggtgtaggtgagatcataggaacagtccctgccccagctgaacatcaggaagccagactgggagcacatgccgtggctgactaggactccagcagggacctggggttccatcagatcagtgtaaagcgatggtttcccaaatgagacctctccagagatggttcattccaccccgcaatggccaccagaaacattgtgctgaccagagggcttcactgccccaaaccccaaaatcacactccaggatgagaaacctaaaagtctatcttgatgaggcttcatagctggaaaccacccctcatggatccacaggctgcatttgatgaaaggagactccaggaagtcgagccattccaggcagacatgtagcaaaagcccgagctggggtccgccctcatgcaataaataacacctgtgcacataagagaggtgacaggcagggcatccctggggacctgggcctgtggcacgtgaagaaacacccaagagagcacgaagtcccaatgccatgaccagatatttcggtgccaggcatgcttctgggtcccagcaaaagacacacaaatccgtgtccttggggacccacagtctagtgacctagggctggccgggtcgcacgcttcttttcaagggctcgaaagcctctgcatggatgcaactttgggggaaaagtaaccctaaccctctgcttctctcatcctcccctcttctgtgtatatgtctgtctctttctctctgtgtgtgcccttccccactcccatccccattcctttttttatttattatattttggtggtgtgtggctcggtttctgttggtcccctcgtgtggcccctcccctgctgcagaactcgtccagctcggcctcctccgaagcctcggaaacctgccagtcagtgagcgagtgcagctcccccacctctgtcagctcgggctccaccatgggtgcctgggtgtccacagagaaggtgaccgcccgggtggcagccacagcggccccactctccctggtccccctgcctgctgctcagacagccctcacagccgcggcaacctggaagctcagaatcgacaccaagagtggggctcctcttggggacagagggtgggacaaggctgagagcattttctagaatgagtgcctggctgctggacaatgaccacatggttgtctcaagggagaggaaggggtatggggaatttggaggtgtgaaggctttctcccagaccaggtgttgcgtgcctgtccatcctcctccctcccttcccgagccacccaccagaccgttggatgagccatgtcactgtgtcagaggctgtgtgcttttccgctttttagtttgcacccccacagagagagctcggtaccacactat

SEQ ID NO: 351820 - DNA, 4760 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa
